(12) United States Patent
Impagliazzo et al.

(10) Patent No.: US 10,117,925 B2
(45) Date of Patent: Nov. 6, 2018

(54) INFLUENZA VIRUS VACCINES AND USES THEREOF

(71) Applicant: Janssen Vaccines & Prevention B.V., Leiden (NL)

(72) Inventors: Antonietta Impagliazzo, Leiden (NL); Jan Willem Meijberg, Leiden (NL); Katarina Radosevic, Nootdorp (NL); Michelle Wagner, San Diego, CA (US); Zhaoqing Ding, San Diego, CA (US)

(73) Assignee: Janssen Vaccines & Prevention B.V., Leiden (NL)

( * ) Notice: Subject to any disclaimer, the term of this patent is extended or adjusted under 35 U.S.C. 154(b) by 0 days.

(21) Appl. No.: 15/324,939

(22) PCT Filed: Jul. 9, 2015

(86) PCT No.: PCT/EP2015/065663
§ 371 (c)(1),
(2) Date: Jan. 9, 2017

(87) PCT Pub. No.: WO2016/005482
PCT Pub. Date: Jan. 14, 2016

(65) Prior Publication Data
US 2017/0189519 A1     Jul. 6, 2017

Related U.S. Application Data

(60) Provisional application No. 62/062,754, filed on Oct. 10, 2014.

(30) Foreign Application Priority Data

Jul. 10, 2014  (EP) .................................. 14176459
Nov. 27, 2014  (EP) .................................. 14195143
Feb. 19, 2015  (EP) .................................. 15155761

(51) Int. Cl.
| | | |
|---|---|---|
| *C07K 14/005* | (2006.01) | |
| *A61K 39/00* | (2006.01) | |
| *A61K 39/145* | (2006.01) | |
| *A61K 39/12* | (2006.01) | |
| *C12N 7/00* | (2006.01) | |
| *C07K 14/11* | (2006.01) | |

(52) U.S. Cl.
CPC ............ *A61K 39/145* (2013.01); *A61K 39/12* (2013.01); *C07K 14/11* (2013.01); *A61K 2039/55577* (2013.01); *C12N 2760/16122* (2013.01); *C12N 2760/16123* (2013.01); *C12N 2760/16134* (2013.01)

(58) Field of Classification Search
CPC .... C07K 14/005; A61K 39/12; A61K 39/145; C12N 2760/16034; C12N 2760/16134
See application file for complete search history.

(56) References Cited

FOREIGN PATENT DOCUMENTS

| | | |
|---|---|---|
| WO | 2008028946 A1 | 3/2008 |
| WO | 2010130636 A1 | 11/2010 |
| WO | 2013007770 A1 | 1/2013 |
| WO | 2013079473 A1 | 6/2013 |
| WO | 2014191435 A1 | 12/2014 |
| WO | 2016005480 A1 | 1/2016 |

OTHER PUBLICATIONS

Lu et al., Production and stabilization of the trimeric influenza hemagglutinin stem domain for potentially broadly protective influenza vaccines, PNAS, 2014, 111(1):125-130.*
Alberini et al., "Pseudoparticle Neutralization is a Reliable Assay to Measure Immunity and Cross-Reactivity to H5N1 Influenza Viruses", Vaccine, vol. 27, pp. 5998-6003 (2009).
Bommakanti et al., "Design of *Escherichia coli*-Expressed Stalk Domain Immunogens of H1N1 Hemagglutinin That Protect Mice from Lethal Challenge", Journ. of Virology, vol. 86, No. 24, pp. 13434-13444 (Dec. 2012).
Cheng et al., "Development of a Robust Reporter-based ADCC Assay with Frozen, Thaw-and-use Cells to Measure Fc Effector Function of Therapeutic Antibodies", Journ. Immunol. Methods, vol. 414, pp. 69-81 (2014).
Coffman et al., "Vaccine Adjuvants" Putting Innate Immunity to Work, Immunity, vol. 33, pp. 492-503(Oct. 2010).
DiLillo et al., "Broadly Neutralizing Hemagglutinin Stalk-Specific Antibodies Require FcγR Interactions for Protection Against Influenza Virus in Vivo", Nat. Med., vol. 20, No. 2, pp. 143-153 (Feb. 2014).
Devereux et al., "A Comprehensive Set of Sequence Analysis Programs for the VAX", Nucl. Acids Res., vol. 12, No. 1, pp. 387-395 (1984).
Dopheide et al., "The Location of the Bromelain Cleavage Site in a Hong Kond Influenza Virus Haemagglutinin", Journ. Gen. Virol., vol. 52, pp. 367-370 (1981).
Ekiert et al., "A Highly Conserved Neutralizing Epitope on Group 2 Influenza A Viruses", Science, vol. 333, No. 6044, pp. 843-850 (2011).
Ferguson et al., "Ecological and Immunological Determinants of Influenza Evolution", Nature, vol. 422, pp. 428-443 (Mar. 2003).
Lorieau et al., "The Complete Influenza Hemagglutinin Fusion Domain Adopts a Tight Helical Hairpin Arrangement at the Lipid:Water Interface", Proc. Natl. Acad. Sci., vol. 107, No. 25, pp. 11341-11346 (Jun. 2010).
Parekh et al., "Development and Validation of an Antibody-Dependent Cell-Mediated Cytotoxicity-Reporter Gene Assay", mAbs, vol. 4, No. 3, pp. 310-318 (2012).

(Continued)

*Primary Examiner* — Barry A Chestnut
(74) *Attorney, Agent, or Firm* — Panitch Schwarze Belisario & Nadel LLP

(57) ABSTRACT

Provided herein are multimeric influenza hemagglutinin stem domain polypeptides, methods for providing hemagglutinin stem domain polypeptides, compositions comprising the same, vaccines comprising the same and methods of their use, in particular in the detection, prevention and/or treatment of influenza.

21 Claims, 60 Drawing Sheets

Specification includes a Sequence Listing.

(56) References Cited

OTHER PUBLICATIONS

Schnueriger et al., "Development of a Quantitative, Cell-Line Based Assay to Measure ADCC Activity Mediated by Therapeutic Antibodies", Molec. Immun., vol. 48, pp. 1512-1517 (2011).
Steel et al., "Influenza Vaccine Based on the Conserved Hemagglutinin Stalk Domain", mBio, vol. 1, No. 1, pp. 1-9 (Apr. 2010).
Stevens et al., "Structure of the Uncleaved Human H1 Hemagglutinin from the Extinct 1918 Influenza Virus", Science, vol. 303, pp. 1866-1870 (Mar. 2004).
Stevens et al., "Structure and Receptor Specificity of the Hemagglutinin from an H5N1 Influenza Virus", Science, vol. 312, pp. 404-410 (Apr. 2006).
Temperton et al., "A Sensitive Retroviral Pseudotype Assay for Influenza H5N1-Neutralizing Antibodies", Viruses, vol. 1, No. 3,, pp. 105-112 (2007).
Throsby et al., Heterosubtypic Neutralizing Monoclonal Antibodies Cross-Protective Against H5N1 and H1N1 Recovered from Human IgM Memory B Cells, Plos One, vol. 3 No. 12, pp. 1-15 (Dec. 2008).
Wilson et al., "Structure of the Haemagglutinin Membrane Glycoprotein of Influenza Virus at 3 A Resolution", Nature, vol. 289, pp. 366-373 (Jan. 1981).
Lu et al., "Production and Stabilization of the Trimeric Influenza Hemagglutinin Stem Domain for Potentially Broadly Protective Influenza Vaccines", Proc. of the Nat. Acad. of Sciences, pp. 1-27 (2013).
Int'l Search Report and Written Opinion dated Sep. 30, 2015 in Int'l Application No. PCT/EP2015/065663.
Bommakanti et al., "Design of an HA2-Based *Escherichia coli* Expressed Influenza Immunogen that Protects Mice from Pathogenic Challenge", Proc. of the Nat. Acad. of Sciences, vol. 107, No. 31, pp. 13701-13706 (Aug. 2010).
Ekiert et al., "Antibody Recongnition of a Highly Conserved Influenza Virus Epitope", Science, vol. 324, pp. 246-251 (Apr. 2009).
Mallajosyula et al., "Influenza Hemagglutinin Stem-Fragment Immunogen Elicts Broadly Neutralizing Antibodies and Confers Heterologous Protection", Proc. of the Nat. Acad. of Sciences, vol. 111, No. 25, pp. E2514-E2523 (Jun. 2014).
Atsmon et al., "Safety and Immunogenicity of Multimeric-001—a Novel Universal Influenza Vaccine", Journ. Clin Immunol., vol. 32, pp. 595-603 (2012).
Safronetz et al., "Pandemic Swine-Origin H1N1 Influenza A Virus Isolates Show Heterogeneous Virulence in Macaques", Journ. of Virol., vol. 85, No. 3, pp. 1214-1223 (Feb. 2011).
Sun et al., "Modifications to the hemagglutinin cleavage site control the virulence of a neurotropic H1N1 influenza virus," Journ. of Virol., vol. 84, No. 17, pp. 8683-8690 (Sep. 2010).
Degorce et al., "HTRF: A technology tailored for drug discovery—a review of theoretical aspects and recent applications," Curr. Chem. Genomics 3:22-32 (2009).
Int'l Search Report and Written Opinion dated Mar. 5, 2013 in Int'l Application No. PCT/EP2012/073706.
Int'l Search Report and Written Opinion dated Sep. 16, 2014 in Int'l Application No. PCT/EP2014/060997.

\* cited by examiner

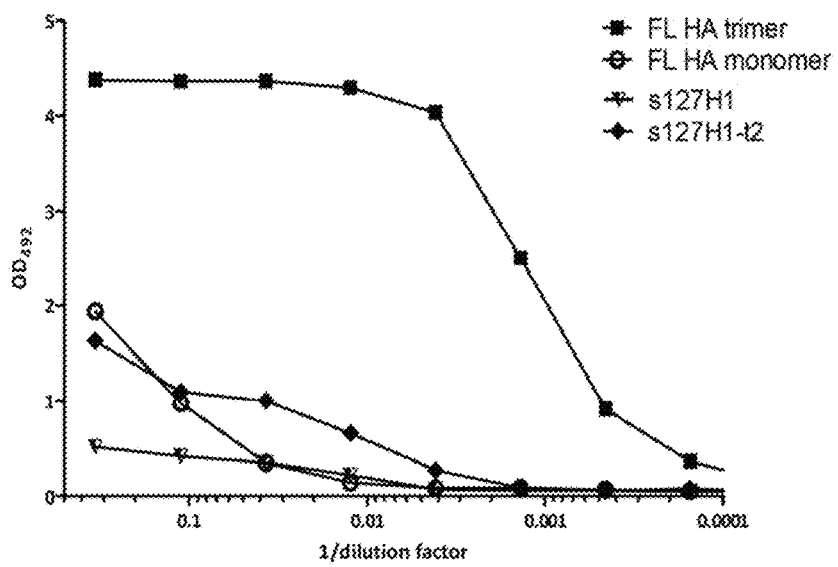
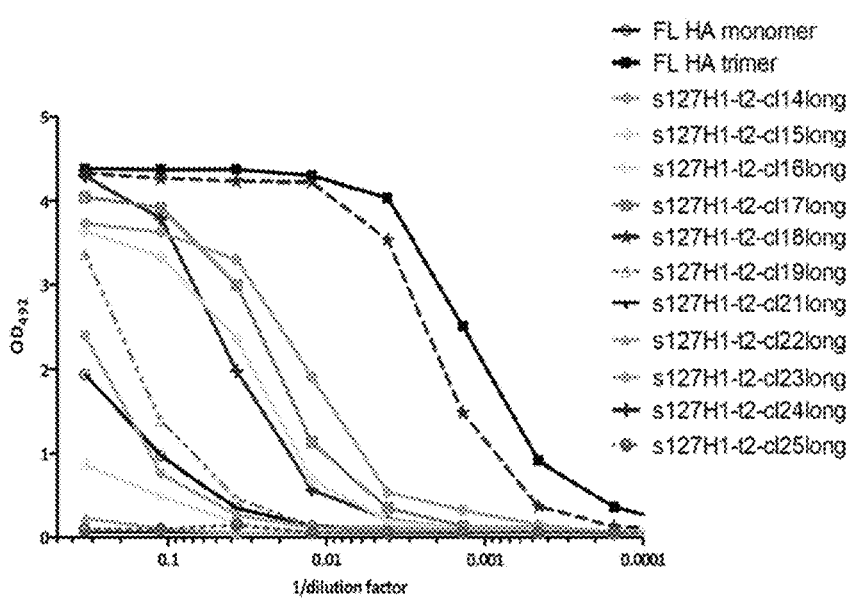
Fig. 2 - continued

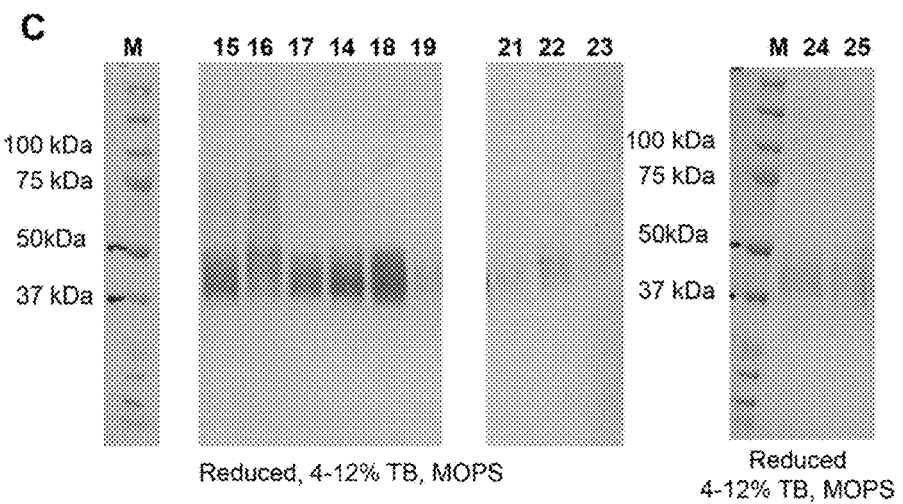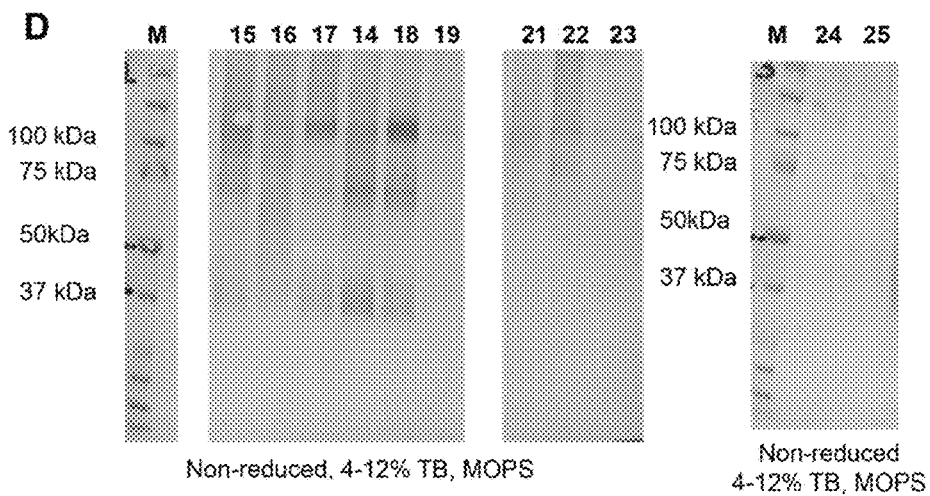
Fig. 3 - continued

A

B

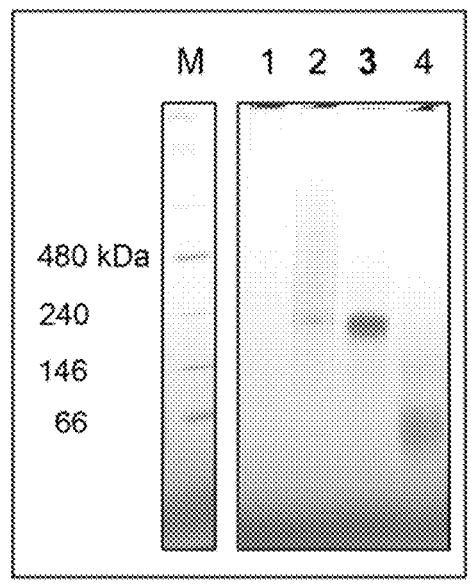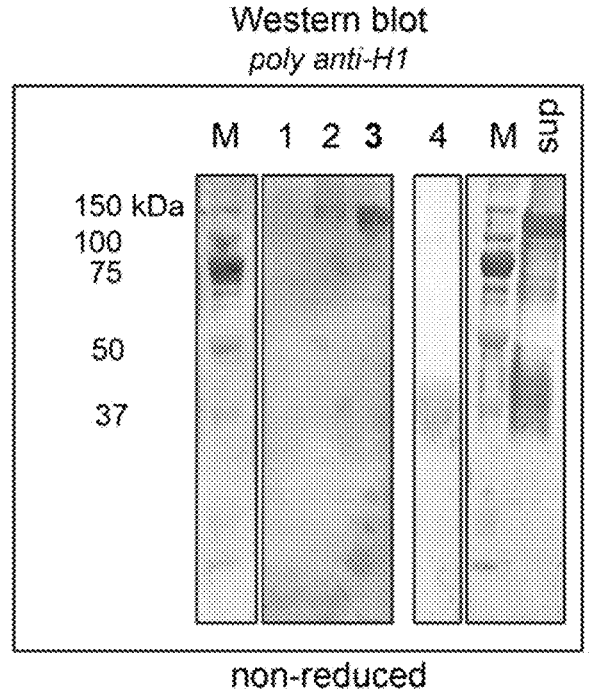
Fig. 5 - continued

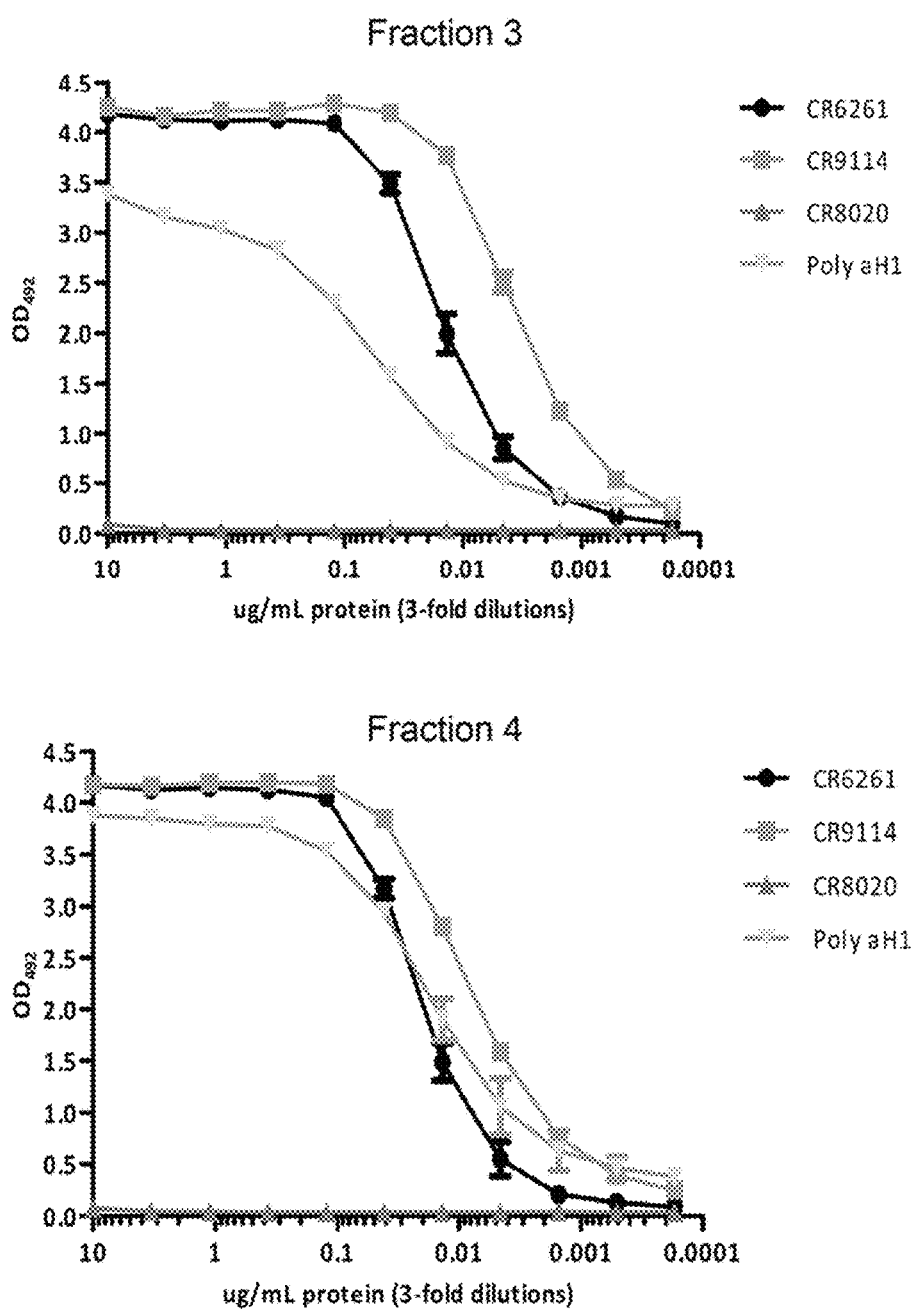
Fig. 6 - continued

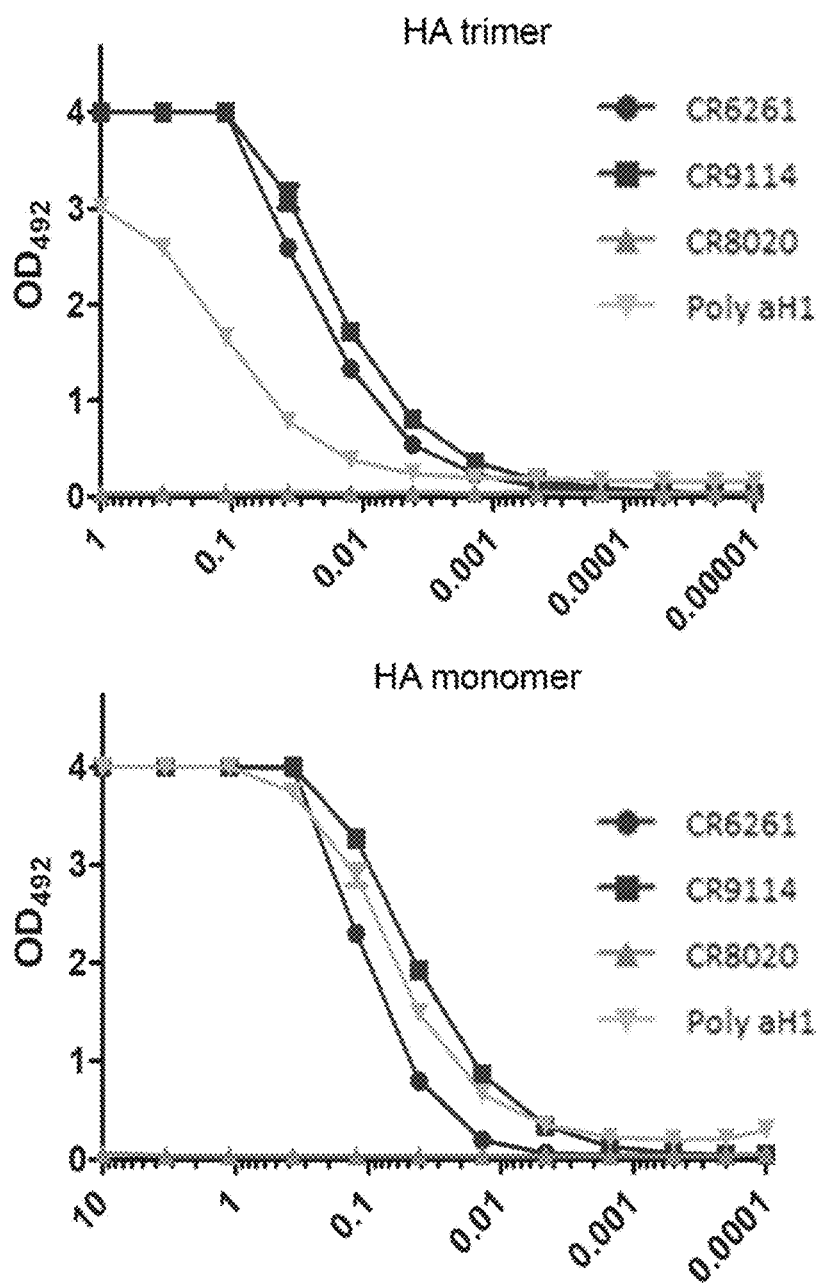
Fig. 6 - continued

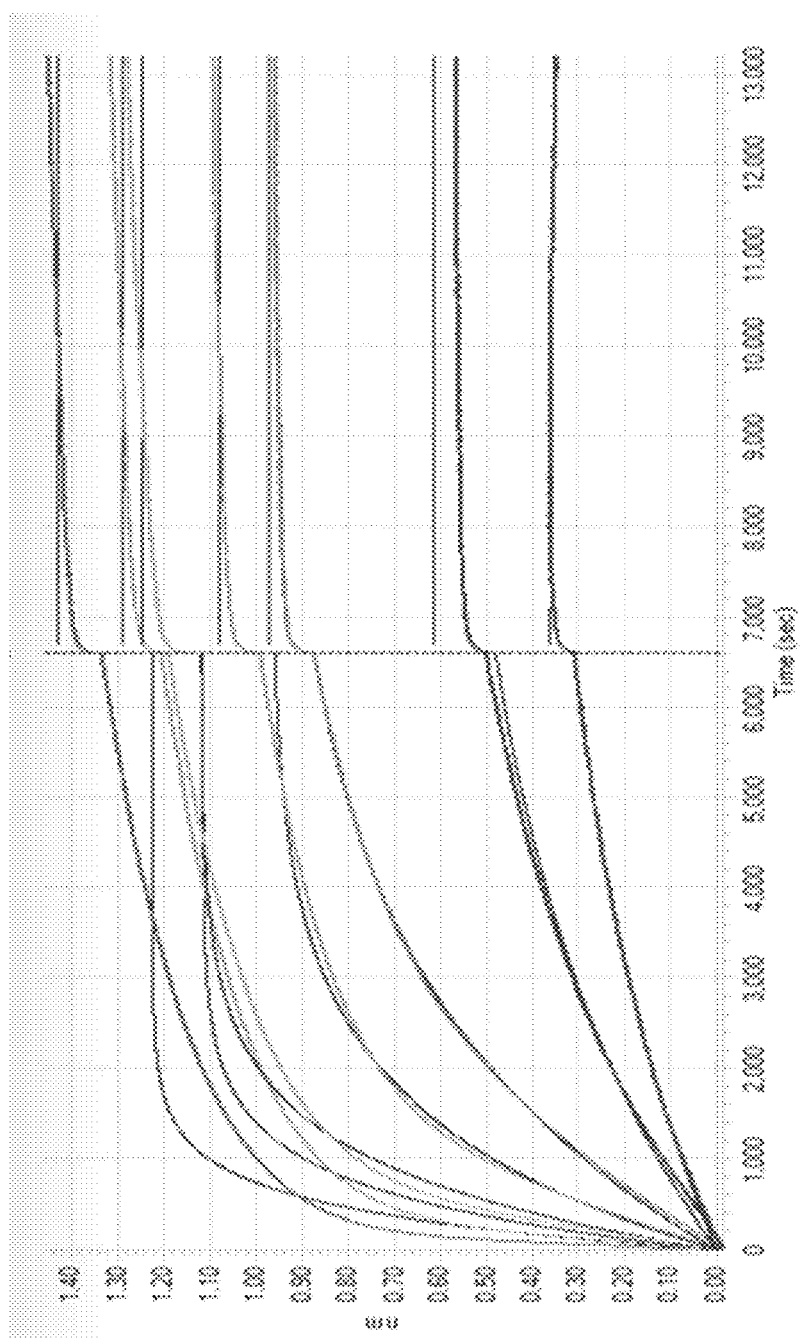
Fig. 9 - continued

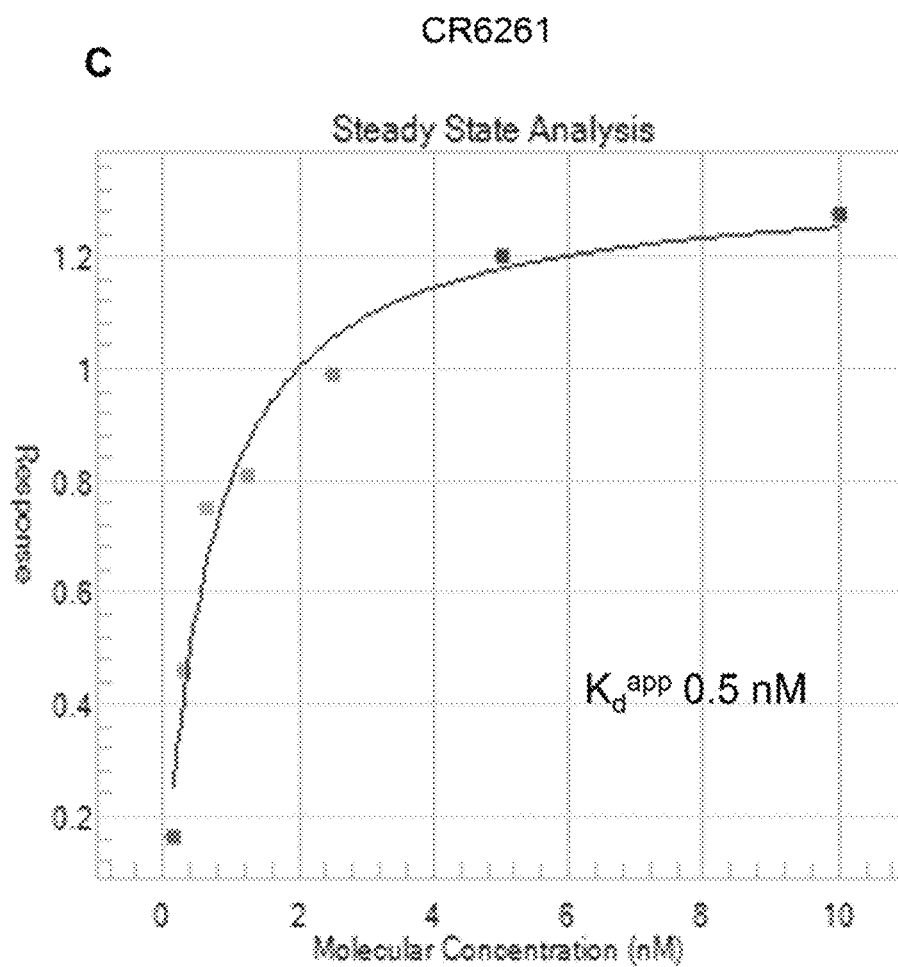
Fig. 9 - continued

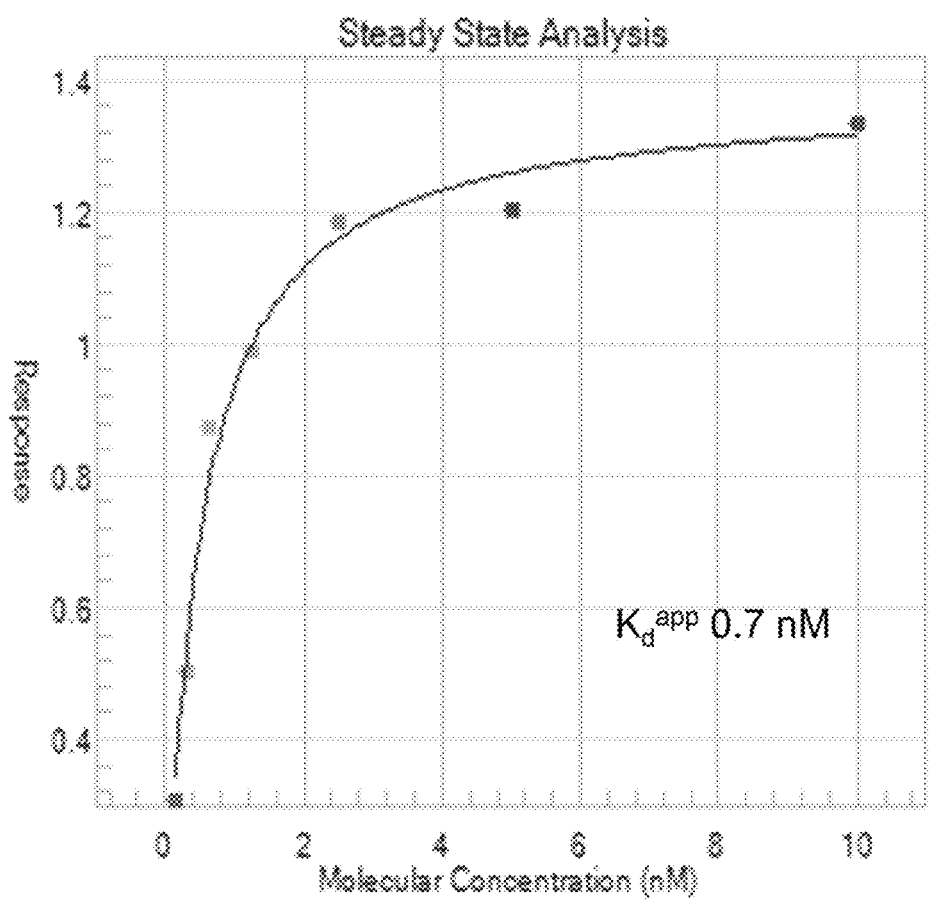
Fig. 9 - continued

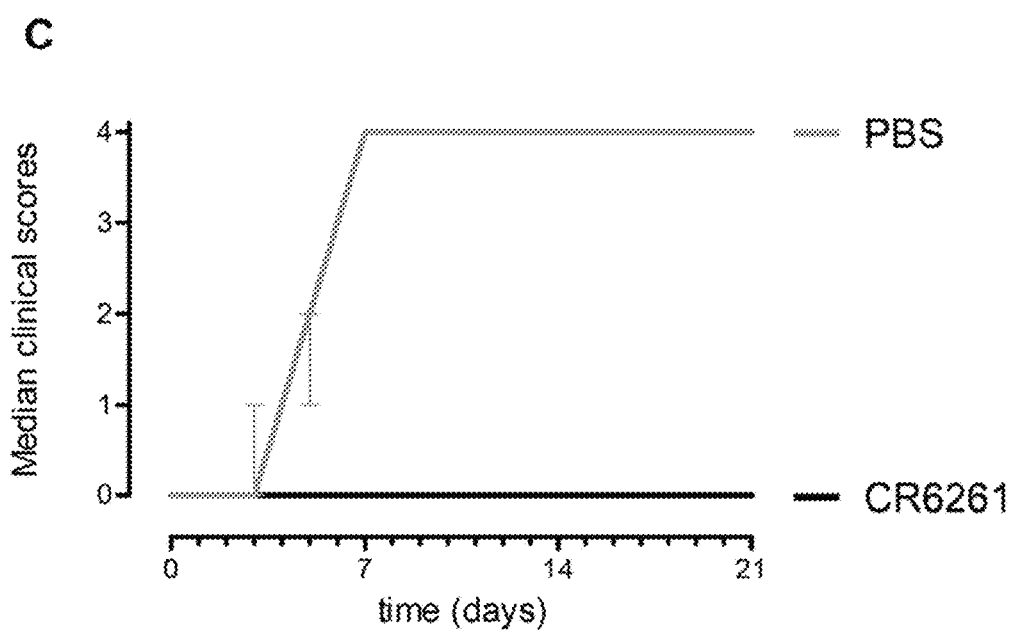
Fig. 10 - continued

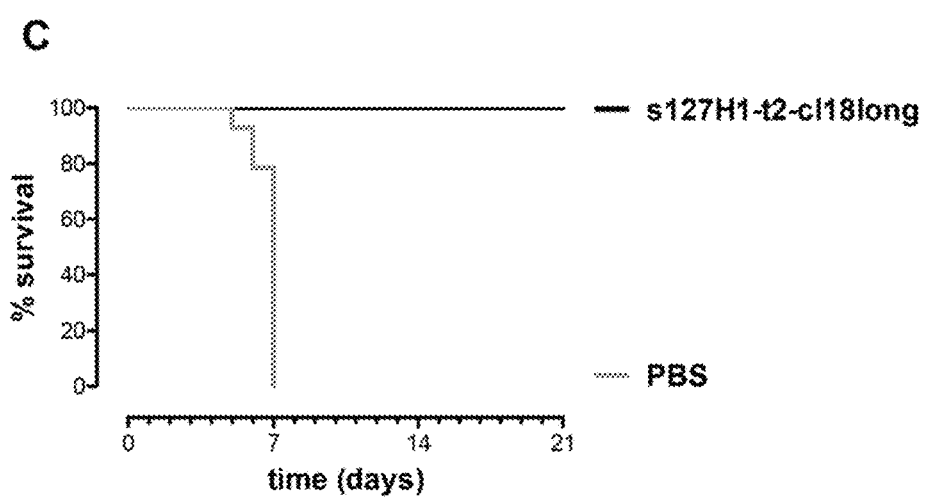
Fig. 11 - continued

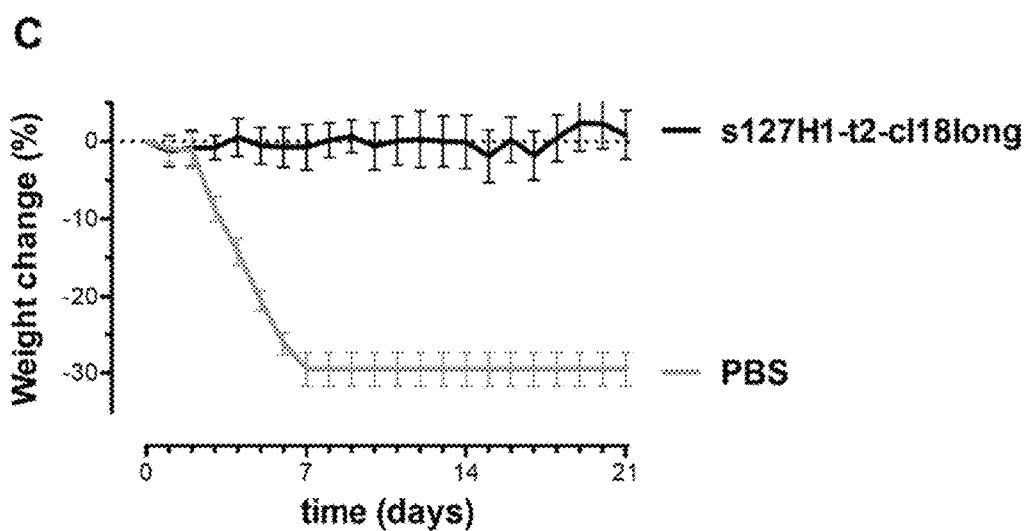
Fig. 12 - continued

A

B

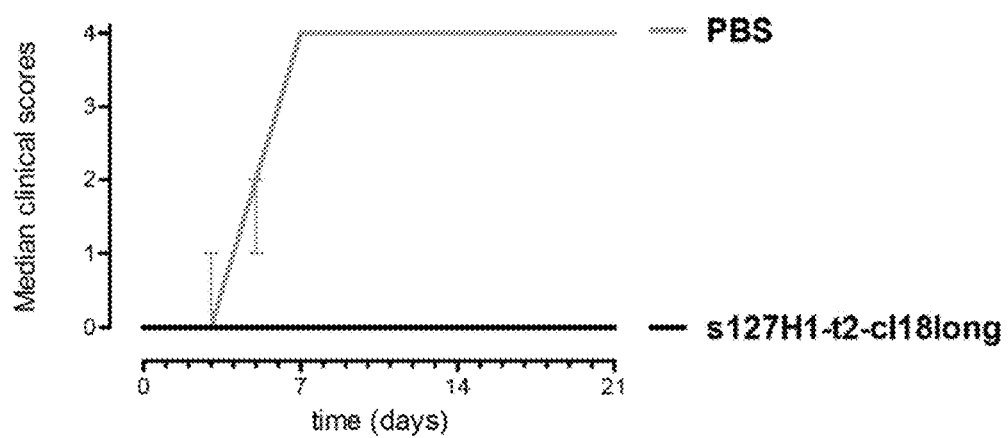
Fig. 13 - continued

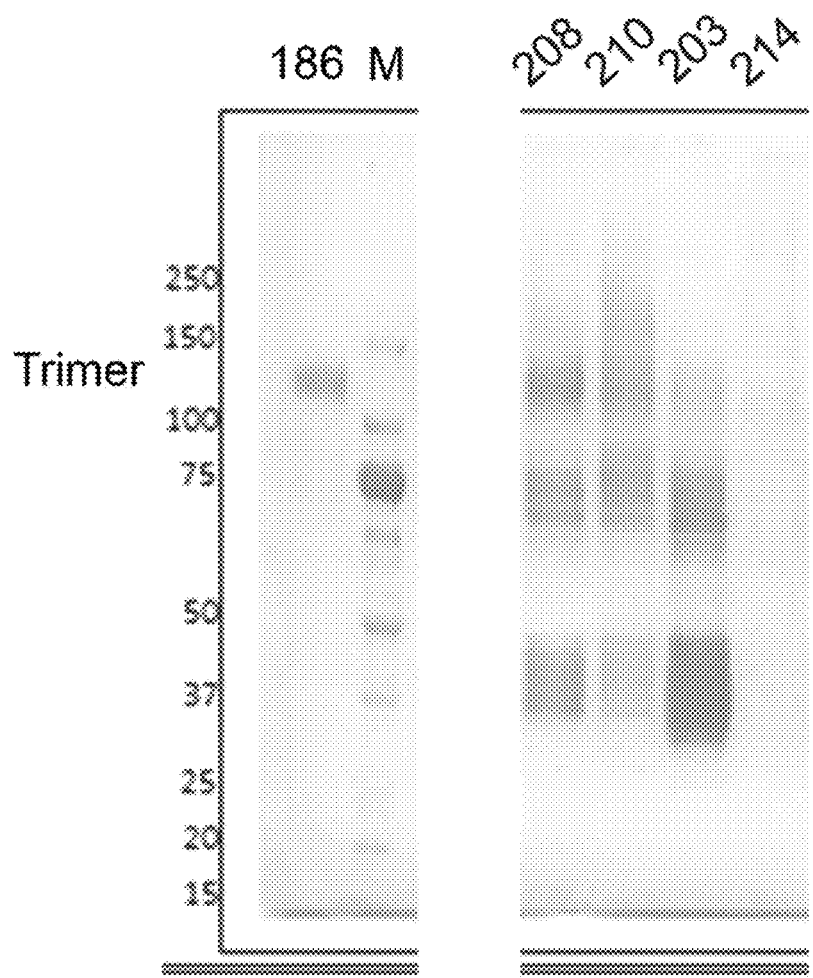
Fig. 22 - continued

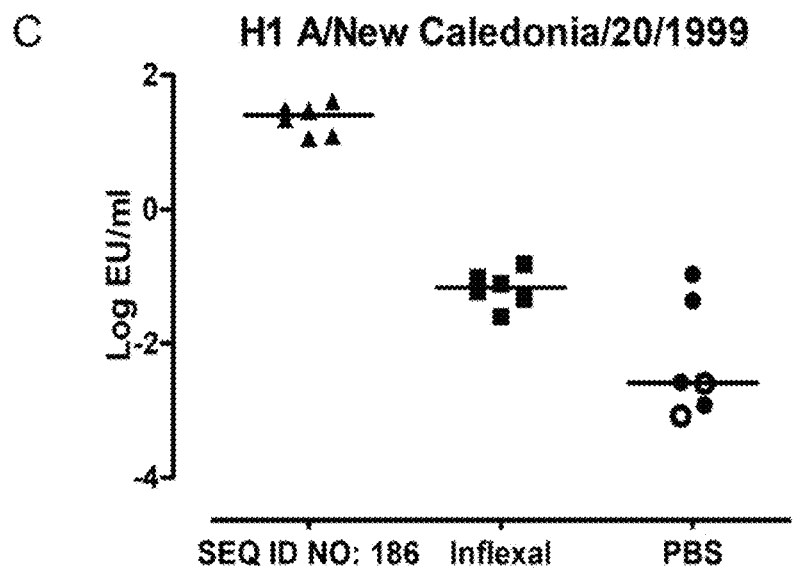
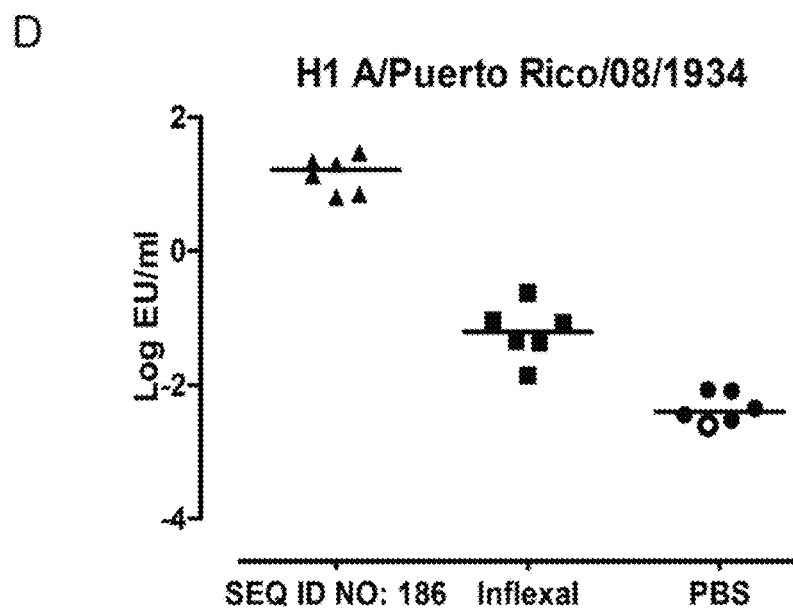
Fig. 23 - continued

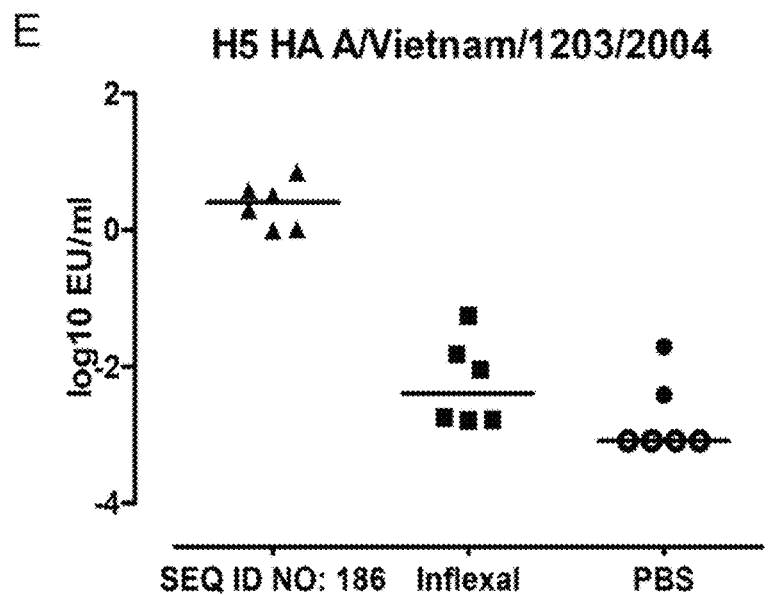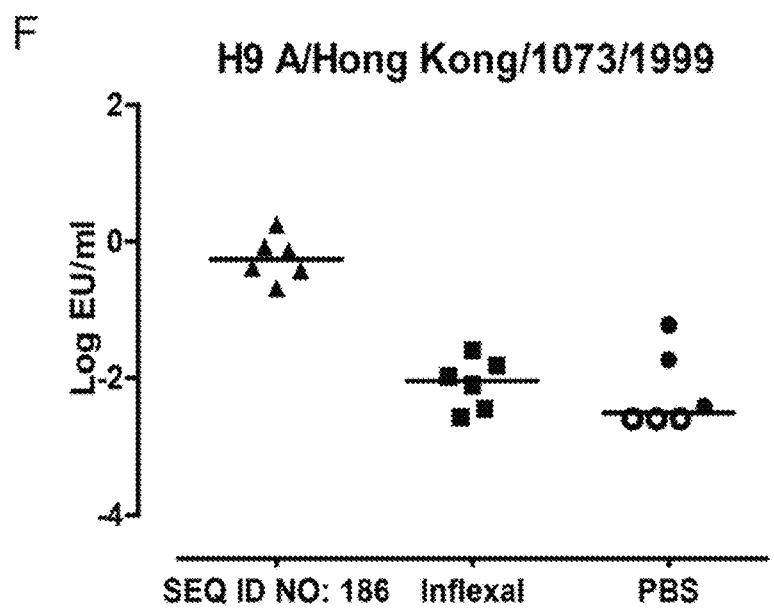
Fig. 23 - continued

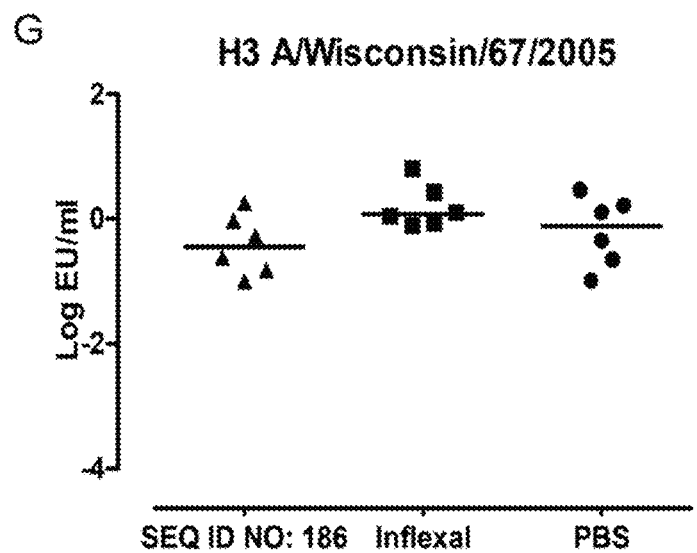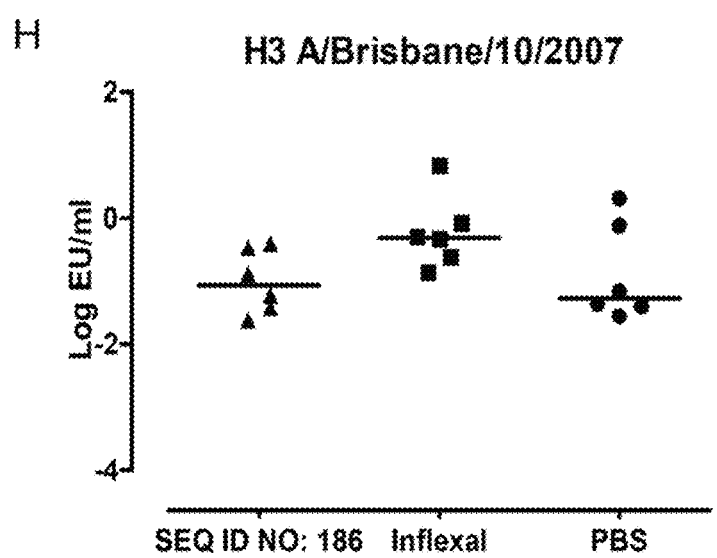
Fig. 23 - continued

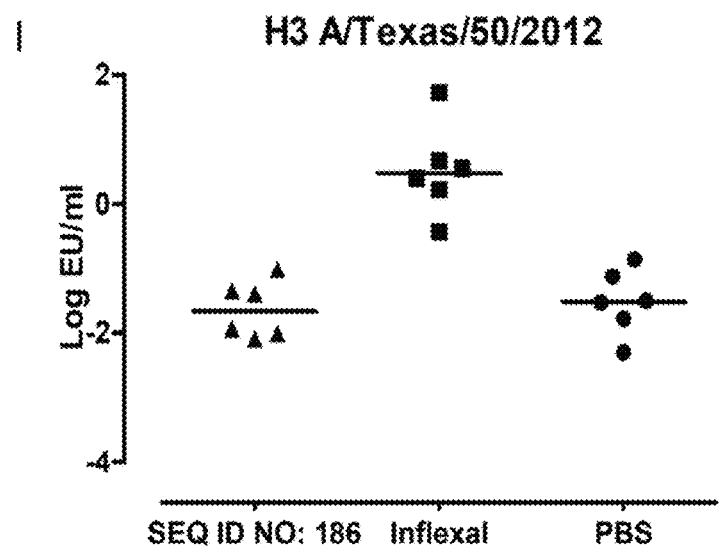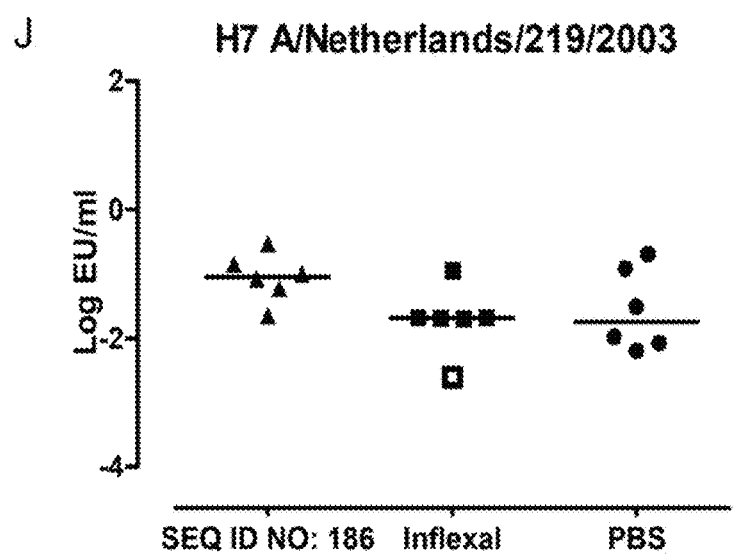
Fig. 23 - continued

INFLUENZA VIRUS VACCINES AND USES THEREOF

CROSS REFERENCE TO RELATED APPLICATIONS

This application is a Section 371 of International Application No. PCT/EP2015/065663, which was published in the English Language on Jan. 14, 2016, under International Publication No. WO/2016/005482, which claims priority to U.S. Provisional Application No. 62/062,754, filed on Oct. 10, 2014, Each disclosure is incorporated herein by reference in its entirety.

REFERENCE TO SEQUENCE LISTING SUBMITTED ELECTRONICALLY

This application contains a sequence listing, which is submitted electronically via EFS-Web as an ASCII formatted sequence listing with a file name "688097-214U.S. Sequence Listing" and a creation date of Jan. 6, 2017, and having a size of 681 kB. The sequence listing submitted via. EFS-Web is part of the specification and is herein incorporated by reference in its entirety.

INTRODUCTION

The invention relates to the field of medicine. Provided herein are influenza hemagglutinin stem domain polypeptides, methods for providing hemagglutinin stem domain polypeptides, compositions comprising the same, vaccines comprising the same and methods of their use, in particular in the detection, prevention and/or treatment of influenza.

BACKGROUND

Influenza viruses are major human pathogens, causing a respiratory disease (commonly referred to as "influenza" or "the flu") that ranges in severity from sub-clinical infection to primary viral pneumonia which can result in death. The clinical effects of infection vary with the virulence of the influenza strain and the exposure, history, age, and immune status of the host. Every year it is estimated that approximately 1 billion people worldwide undergo infection with influenza virus, leading to severe illness in 3-5 million cases and an estimated 300,000 to 500,000 of influenza related deaths. The bulk of these infections can be attributed to influenza A viruses carrying H1 or H3 hemagglutinin subtypes, with a smaller contribution from Influenza B viruses, and therefore representatives of all three are included in the seasonal vaccine. The current immunization practice relies on early identification of circulating influenza viruses to allow for timely production of an effective seasonal influenza vaccine. Apart from the inherent difficulties in predicting the strains that will be dominant during the next season, antiviral resistance and immune escape also play a role in failure of current vaccines to prevent morbidity and mortality. In addition to this the possibility of a pandemic caused by a highly virulent viral strain originating from animal reservoirs and reassorted to increase human to human spread, poses a significant and realistic threat to global, health.

Influenza A viruses are widely distributed in nature and can infect a variety of birds and mammals. Influenza viruses are enveloped RNA viruses that belong to the family of Orthomyxoviridae. Their genomes consist of eight single-stranded RNA segments that code for 11 different proteins, one nucleoprotein (NP), three polymerase proteins (PA, PB1, and PB2), two matrix proteins (M1 and M2), three non-structural proteins (NS1, NS2, and PB1-F2), and two external glycoproteins: hemagglutinin (HA) and neuraminidase (NA). The viruses are classified on the basis of differences in antigenic structure of the HA and NA proteins, with their different combinations representing unique virus subtypes that are further classified into specific influenza virus strains. Although all known subtypes can be found in birds, currently circulating human influenza A subtypes are H1N1 and H3N2. Phylogenetic analysis has demonstrated a subdivision of hemagglutinina into two main groups: inter alia the H1, H2, H5 and H9 subtypes in phylogenetic group 1 and inter alia the H3, H4 and H7 subtypes in phylogenetic group 2.

The influenza type B virus strains are strictly human. The antigenic variation in HA within the influenza type B virus strains is smaller than those observed within the type A strains. Two genetically and antigenically distinct lineages of influenza B virus are circulating in humans, as represented by the B/Yamagata/16/88 (also referred to as B/Yamagata) and B/Victoria/2/87 (B/Victoria) lineages (Ferguson et al., 2003). Although the spectrum of disease caused by influenza B viruses is generally milder than that caused by influenza A viruses, severe illness requiring hospitalization is still frequently observed with influenza B infection.

It is known that antibodies that neutralize the influenza virus are primarily directed against hemagglutinin (HA). Hemagglutinin or HA is a trimeric glycoprotein that is anchored to the viral coat and has a dual function: it is responsible for binding to the cell surface receptor sialic acid and, after uptake, it mediates the fusion of the viral and endosomal membrane leading to release of the viral RNA in the cytosol of the cell. HA comprises a large head domain and a smaller stem domain. Attachment to the viral membrane is mediated by a C-terminal anchoring sequence connected to the stem domain. The protein is post-translationally cleaved in a designated loop to yield two polypeptides, HA1 and HA2 (the full sequence is referred to as HA0). The membrane distal head region is mainly derived from HA1 and the membrane proximal stem region primarily from HA2 (FIG. 1)

The reason that the seasonal influenza vaccine must be updated every year is the large variability of the virus. In the hemagglutinin molecule this variation is particularly manifested in the head domain where antigenic drift and shift have resulted in a large number of different variants. Since this is also the area that is immunodominant, most neutralizing antibodies are directed against this domain and act by interfering with receptor binding. The combination of immunodominance and large variation of the head domain also explains why infection with a particular strain does not lead to immunity to other strains: the antibodies elicited by the first infection only recognize a limited number of strains closely related to the virus of the primary infection.

Recently, influenza hemagglutinin stem domain polypeptides, lacking all or substantially all of the influenza hemagglutinin globular head domain, have been described and used to generate an immune response to one or more conserved epitopes of the stem domain polypeptide. It is believed that epitopes of the stem domain polypeptide are less immunogenic than the highly immunogenic regions of a globular head domain, thus the absence of a globular head domain in the stem domain polypeptide might allow an immune response against one or more epitopes of the stem domain polypeptide to develop (Steel et al., 2010). Steel et al. thus have created a new molecule by deleting amino acid residue 53 to 276 of HA1 of the A/Puerto Rico/8/1934 (H1N1) and A/Hong Kong/1968 (H3N2) strains from the HA primary sequence, and replacing this by a short flexible linking sequence GGGG. Vaccination of mice with the H3 HK68 construct did not elicit antisera that were cross-reactive with group 1 HAs. In addition, as shown in PCT/EP2012/073706, the stem domain polypeptides were highly unstable and did not adopt the correct conformation as proven by the lack of binding of antibodies that were shown to bind to conserved epitopes in the stem region.

In addition, Bommakanti et al. (2010) described an HA2 based polypeptide comprising amino acid residues 1-172 of HA2, a 7-amino acid linker (GSAGSAG), amino acid residues 7-46 of HA1, a 6-amino acid linker GSAGSA, followed by residues 290-321 of HA1, with the mutations V297T, I300E, Y302T and C305T in HA1. The design was based on the sequence of H3 HA (A/Hong Kong/1968). The polypeptide did only provide cross-protection against another influenza virus strain within the H3 subtype (A/Phil/2/82 but not against an H1 subtype (A/PR/8/34). In a more recent paper by Bommakanti et al (2012) a stem domain sequence based on HA from H1N1 A/Puerto Rico/8/1934 (H1HA0HA6) is described. In this polypeptide the equivalent of residues 55 to 302 have been deleted and mutations I311T, V314T, I316N, C319S, F406D, F409T, and L416D have been made. Both the H3 and HA based polypeptides were expressed in E. coli and therefore lack the glycans that are a part of the naturally occurring HA proteins. When expressed in E. coli the polypeptide is recovered mainly as high molecular weight aggregates and a minor monomeric fraction. The polypeptide binds CR6261 with two apparent dissociation constants of 9 and 0.2 µM. The authors show that mice can survive a challenge with 1 LD90 of the homologous H1N1 A/Puerto Rico8/1934 virus after immunization (twice, 4 week interval) with 20 µg of protein adjuvanted with 100 µg of CpG7909. The authors also describe circularly permutated polypeptides comparable to those described above for A/Hong Kong/1/1968 derived polypeptides. These polypeptides are derived from HA's from H1N1 A/Puerto Rico/8/1934, H1N1 A/North Carolina/20/99 or H1N1 A/California/07/2009 and can provide partial protection in a mild challenge (1LD90) model in mice of H1N1 A/Puerto Rico/8/1934 (i.e. within the same subtype). Sera from guinea pigs immunized with these polypeptides did not exhibit detectable levels of neutralization when tested in a neutralization assay.

More recently Lu et al (2013) also described soluble stem domain polypeptides derived from the HA of H1N1 A/California/05/2009. In the final design the equivalent of residues 54-303 (numbering according to SEQ ID NO: 1) have been deleted (the leader sequence, residues 1-17 is also not present) and two mutations have been introduced in the B-loop of the protein, i.e. F407D, and L413D. Furthermore the polypeptide contained a C-terminal trimerization domain (foldon). In addition, two intermonomer disulfide bridges were introduced, one in the area of the trimeric foldon domain, and one at position 430 and 431. The polypeptide is produced in an E. coli based cell free system, (and thus lacks the glycans that are part of the naturally occurring HA proteins) and is recovered in a denatured form, which needs to be refolded prior to use. No immunological or protection from influenza challenge data were shown, so immunogenicity and efficacy of this polypeptide is not known.

In a recent paper Mallajosyula et al (2014) also report a stem domain polypeptide. In this design, based on the HA from H1N1 A/Puerto Rico/8/1934 not only a large part of the HA1 sequence is deleted (residue 42 to 289, numbering according to SEQ ID NO: 1), but also large part of the N- and C-terminal sequences of HA2 (residues 344 to 383 and 457 to 565, respectively). It is noteworthy that in H3 HA proteins the deleted part contains broadly neutralizing epitopes, e.g. those of CR8020 and CR8043. The polypeptide again contains a foldon trimerization domain at the C-terminus and is also produced in E. coli, so lacks the naturally occurring glycans on viral HA. The polypeptide binds the broadly neutralizing antibodies and is CR6261, F10 and F16v3. The polypeptide was also tested in an influenza challenge model (1LD90 of H1N1 A/Puerto Rico/8/1934) and could protect mice from death. Equivalent polypeptides derived from HA of H1N1 A/New Caledonia/20/1999 and H1N1 A/California/04/2009 could also partially protect. An equivalent polypeptide derived from H5N1 A/Vietnam/1203/2004 only gave limited protection in this challenge model. Moreover, only one influenza strain was used to challenge the animals with a relatively low dose administered (1-2 LD90), so protection against multiple influenza strains, a prerequisite for a universal vaccine has not been established.

There thus still exists a need for a safe and effective universal vaccine that stimulates the production of a robust, broadly neutralizing antibody response and that offers protection against a broad set of current and future influenza virus strains (both seasonal and pandemic), in particular providing protection against one or more influenza A virus subtypes within phylogenetic group 1 and/or group 2, for effective prevention and therapy of influenza.

SUMMARY

Provided herein are influenza hemagglutinin stem domain polypeptides, methods for providing stem domain polypeptides, compositions comprising the same, vaccines comprising the same and methods of their use.

In a first aspect, the present invention provides novel immunogenic multimeric polypeptides comprising an influenza hemagglutinin stem domain and lacking the globular head, referred to as influenza hemagglutinin (HA) stem domain polypeptides. The multimeric polypeptides are capable of inducing an immune response when administered to a subject, in particular a human subject. The polypeptides of the invention present conserved epitopes of the membrane proximal stem domain HA molecule to the immune system in the absence of dominant epitopes that are present in the membrane distal head domain. To this end, part of the primary sequence of the HA0 protein making up the head domain is removed and the remaining amino acid sequence is reconnected, either directly or, in some embodiments, by introducing a short flexible linking sequence ('linker') to restore the continuity of the amino acid chain. The resulting sequence is further modified by introducing specific mutations that stabilize the native 3-dimensional structure of the remaining part of the HA0 molecule. The polypeptides do not comprise the full-length HA1 and/or HA2 of an influenza virus.

The present invention provides novel multimeric influenza hemagglutinin stem domain polypeptides, wherein said multimeric polypeptides comprise at least a first and a second influenza hemagglutinin stem domain monomer, said first and second monomer each comprising: (a) an influenza hemagglutinin HA1 domain that comprises an HA1 N-terminal stem segment, covalently linked by a linking sequence of 0-50 amino acid residues to an HA1 C-terminal stem segment, wherein said HA1 C-terminal segment is linked to (b) an influenza hemagglutinin HA2 domain, wherein said HA1 N-terminal segment comprises the amino acids 1-x of HA1, preferably the amino acids p-x of HA1, and wherein the HA1 C-terminal stem segment comprises the amino acids y-C-terminal amino acid of HA1, and (c) wherein the polypeptide comprises no protease cleavage site at the junction between HA1 and HA2; and (d) wherein the first monomer is linked to said second monomer by a disulfide bridge between the amino acid on position 411 of the first monomer and the amino acid on position 419 of the second monomer.

According to the invention, the disulfide bridge thus forms a covalent cross-link between individual monomers in a multimer.

In certain embodiments, the multimeric polypeptide is trimeric, i.e. comprises three monomers. According to the invention, each monomer is linked to another monomer by the disulfide bridge between the amino acid on position 411 of one monomer to the amino acid on position 419 of another monomer. It is noted that the numbering used is in relation to SEQ ID NO: 1. A person skilled in the art will be able to determine the equivalent positions in other HA sequences.

In certain embodiments, the HA1 and HA2 domains are derived from an influenza A virus subtype derived from phylogenetic group 1.

In certain embodiments, the HA1 and HA2 domains are derived from an influenza A virus subtype comprising HA of the H1 subtype.

In certain embodiments, x=the amino acid on position 52 of SEQ ID NO: 1 (or an equivalent position in another hemagglutinin), p=the amino acid on position 18 of SEQ ID NO: 1 (or an equivalent position in another hemagglutinin) and y=the amino acid on position 321 of SEQ ID NO: 1 (or an equivalent position in another hemagglutinin). In certain embodiments, the HA1 N-terminal stem segment thus comprises the amino acids 1-52 of HA1, and the HA1 C-terminal stem segment comprises the amino acids 321-end (i.e. the C-terminal amino acid of HA1) of HA1. Thus, in certain embodiments, the deletion in the HA1 segment comprises the amino acid sequence from the amino acid at position 53 up to and including the amino acid at position 320. In certain embodiments, the polypeptides do not comprise the signal sequence. In certain embodiments, the HA1 N-terminal segment thus comprises the amino acid 18-52 of HA1, wherein p is the first amino acid of the mature HA molecule (e.g. p=18 in case of SEQ ID NO: 1).

In certain embodiments, the HA1 and HA2 domains are derived from an influenza A virus subtype derived from phylogenetic group 2.

In certain embodiments, the HA1 and HA2 domains are derived from an influenza A virus subtype comprising HA of the H3 subtype.

The multimeric polypeptides of the invention thus comprise at least two monomers, each monomer comprising a HA1 domain, said HA1 domain comprising a HA1 N-terminal segment, linked to, either directly or through a linking sequence to a HA1 C-terminal segment, and a HA2 domain. In certain embodiments, the N-terminal amino acid of the HA2 domain is directly linked to the C-terminal amino acid of the HA1 C-terminal segment.

In certain embodiments, the polypeptides comprise the complete HA2 domain, i.e. the HA2 domain including the transmembrane domain and the intracellular sequence. In certain embodiments, the HA2 domains of the monomers have been truncated. Thus, in certain embodiments, the polypeptides of the invention do not contain the intracellular sequences of HA and the transmembrane domain. In certain embodiments, the amino acid sequence from position (or the equivalent of) 514, 515, 516, 517, 518, 519, 520, 521, 522, 523, 524, 525, 526, 527, 526, 528, 529, or 530 of the HA2 domain to the C-terminus of the HA2 domain has been removed.

According to the invention, the C-terminal amino acid of the HA1 C-terminal stem segment is linked to the N-terminal amino acid of the HA2 domain, thus forming a junction between the HA1 and HA2 domain. The polypeptides of the invention do not comprise a protease cleavage site at the junction between the HA1 and HA2 domain. In certain embodiments, the C-terminal amino acid residue of the HA1 C-terminal stem segment (amino acid 343 in SEQ ID NO: 1) is any amino acid other than arginine (R) or lysine (K), preferably glutamine (Q).

The influenza hemagglutinin stem domain monomers in the immunogenic polypeptides of the invention are substantially smaller than HA0, preferably lacking all or substantially all of the globular head of HA. Preferably, the immunogenic monomers are no more than 360, preferably no more than 350, 340, 330, 320, 310, 305, 300, 295, 290, 285, 280, 275, or 270 amino acids in length. In certain embodiments, the immunogenic polypeptides are from about 250 to about 350, preferably from about 260 to about 340, preferably from about 270 to about 330.

The polypeptides of the invention do not comprise the full length HA1.

In certain embodiments, the polypeptides are glycosylated.

According to the invention, the polypeptides further comprise one or more additional mutations in the HA1 and/or HA2 domain, as compared to the amino acid sequence of the wild-type HA, in particular the HA on which the HA1 and HA2 domains are based.

In certain embodiments, the polypeptides of the invention comprise the conserved stem domain epitopes of the group 1 cross-neutralizing antibody CR6261 (as disclosed in WO2008/028946) and/or of the antibody CR9114 (as described in WO2013/007770), an antibody capable of binding to and neutralizing both group 1 and group 2 influenza A viruses, as well as influenza B viruses. It is thus another aspect of the invention to provide HA stem domain polypeptides, wherein said polypeptides stably present the epitopes of the antibody CR6261 and/or CR9114, as indicated by binding of said antibody or antibodies to said polypeptides.

In certain embodiments, the polypeptides do not bind to CR8020 and CR8057 (described in WO 2010/130636), which are monoclonal antibodies that bind to H3 influenza viruses only. The influenza hemagglutinin stem domain polypeptides provided herein are suitable for use in immunogenic compositions (e.g. vaccines) capable of generating immune responses against a plurality of influenza virus A and/or B strains.

In certain embodiments, the polypeptides of the invention comprise the conserved stem domain epitopes of the group 2 cross-neutralizing antibody CR8020 (described in WO 2010/130636).

In certain embodiments, the influenza hemagglutinin stem domain polypeptides are capable of generating immune responses against influenza A virus strains of phylogenetic group 1 and/or group 2, in particular against influenza virus strains of both phylogenetic group 1 and group 2. In an embodiment, the polypeptides are capable of generating an immune response against homologous influenza virus strains. In an embodiment, the polypeptides are capable of generating an immune response against heterologous influenza virus strains of the same and/or different subtypes. In a further embodiment, the polypeptides are capable of generating an immune response to influenza virus strains of both phylogenetic group 1 and group 2 and influenza B virus strains.

The polypeptides according to the invention may be used e.g. in stand alone therapy and/or prophylaxis and/or diagnosis of a disease or condition caused by an influenza virus, in particular a phylogenetic group 1 or 2 influenza A virus and/or an influenza B virus, or in combination with other prophylactic and/or therapeutic treatments, such as (existing or future) vaccines, antiviral agents and/or monoclonal antibodies.

In a further aspect, the present invention provides nucleic acid molecules encoding the influenza HA stem domain polypeptides. In yet another aspect, the invention provides vectors comprising the nucleic acids encoding the immunogenic polypeptides.

In a further aspect, the invention provides methods for inducing an immune response in a subject, the method comprising administering to the subject a polypeptide and/or nucleic acid molecule according to the invention.

In another aspect, the invention provides immunogenic compositions comprising a polypeptide and/or a nucleic acid molecule according to the invention. The immunogenic compositions provided herein can be in any form that allows for the compositions to be administered to a subject, e.g. mice, ferrets or humans. In a specific embodiment, the immunogenic compositions are suitable for human administration. The polypeptides, nucleic acid molecules and compositions may be used in methods of preventing and/or treating an influenza virus disease and/or for diagnostic purposes. The compositions may further comprise a pharmaceutically acceptable carrier or excipient. In certain embodiments, the compositions described herein comprise, or are administered in combination with, an adjuvant.

In another aspect, the invention provides polypeptides, nucleic acids and/or immunogenic compositions for use as a vaccine. The invention in particular relates to immunogenic polypeptides, nucleic acids, and/or immunogenic compositions for use as a vaccine in the prevention and/or treatment of a disease or condition caused by an influenza virus A subtype of phylogenetic group 1 and/or 2 and/or influenza B virus.

The various embodiments and uses of the polypeptides according to the invention will become clear from the following detailed description of the invention.

(B) SDS-PAGE analysis of the fractions collected from the size exclusion column under non-reducing (left) and reducing conditions (right). Numbers above the lanes correspond to FIG. 5A, M denotes a molecular weight marker.

(C) Native PAGE of fractions 1-4. Numbers above the lanes correspond to FIG. 5A, M denotes a molecular weight marker.

(D) Western blot of fractions 1-4, using a polyclonal anti-his-tag antibody for detection. Numbers above the lanes correspond to FIG. 5A, M denotes a molecular weight marker.

FIG. 6. Elisa results for binding of broadly neutralizing antibodies CR6261 and CR9114 to the polypeptides in fraction 1 to 4 as indicated in FIG. 5. Binding to a ploytclonal anti-H1 HA serum and the group 2 specific monoclonal antibody CR8020 are also included. For reasons of comparison results for a soluble HA from H1N1 A/Brisbane/59/2007 in monomeric and trimeric form are also shown.

FIG. 7. CR9114 sandwich ELISA results for fractions 1 to 4 as indicated in FIG. 5. For reasons of comparison results for a soluble HA from H1N1 A/Brisbane/59/2007 in monomeric and trimeric form are also shown.

FIG. 8. SEC-MALS results for the polypeptide of fraction 3 in the absence and presence of Fab fragments of CR8020 (top panel), CR6261 or CR9114 (both bottom panel). Complex formation with Fab fragments of CR9114 and CR6261 leads to an increase in molecular mass and shift of the peak.

FIG. 9. Binding of broadly neutralizing antibodies CR6261 and CR9114 to s127H1-t2-cl18long as determined by bilayer interferometry. A and C show individual binding curves for immobilized monoclonal antibodies exposed to varying concentrations of s127H1-t2-cl18long; B and D show the steady state analysis used to estimate $K_d$.

FIG. 10. Survival (A), relative body weight loss (B) and clinical score (C) for the negative (PBS, 3 immunizations at 3 weeks intervals) and positive control (15 mg/kg CR6261, 1 day before challenge) groups. Mice were challenged four week after the last immunization with a lethal dose (25× LD50) of H1N1 A/Puerto Rico/8/34 and monitored for 21 days. Error bars indicate 95% confidence interval (B) or interquartile range (C).

FIG. 11. Survival for groups immunized 1 time (A), 2 times (B) or 3 times (C) with 30 μg s127H1-t2-cl18long in the presence of 10 μg Matrix-M. Mice were challenged four week after the last immunization with a lethal dose (25× LD50) of H1N1 A/Puerto Rico/8/34 and monitored for 21 days. For reasons of comparison the negative control group (PBS) is also shown.

FIG. 12. Relative body weight change for groups immunized 1 time (A), 2 times (B) or 3 times with 30 μg s127H1-t2-cl18long in the presence of 10 µg Matrix-M. Mice were challenged four week after the last immunization with a lethal dose (25×LD50) of H1N1 A/Puerto Rico/8/34 and monitored for 21 days. For reasons of comparison the negative control group (PBS) is also shown. Error bars indicate 95% confidence interval.

Figure 13:
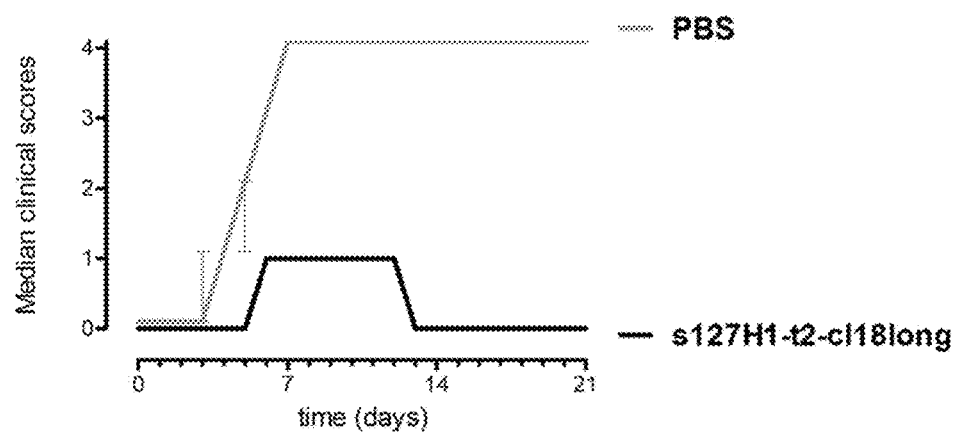
Figure 13:
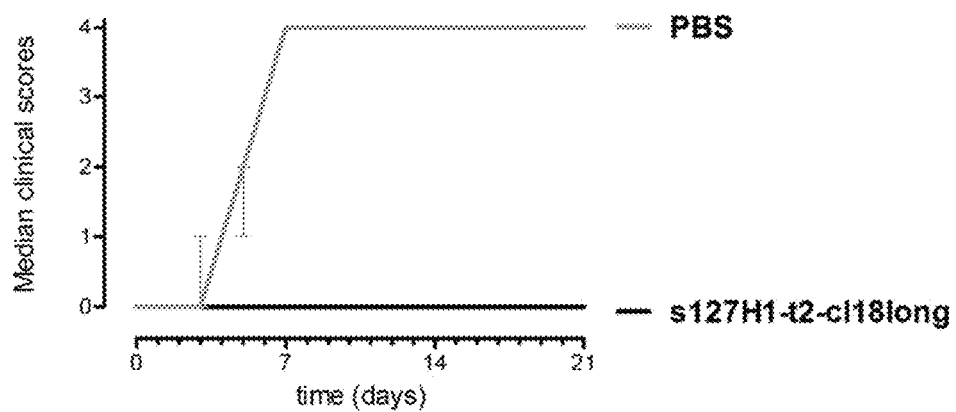

FIG. 13. Clinical scores for groups immunized 1 time (A), 2 times (B) or 3 times with 30 µg s127H1-t2-cl18long in the presence 10 µg Matrix-M. Mice were challenged four week after the last immunization with a lethal dose (25×LD50) of H1N1 A/Puerto Rico/8/34 and monitored for 21 days. For reasons of comparison the negative control group (PBS) is also shown. Error bars indicate interquartile range.

Figure 14:
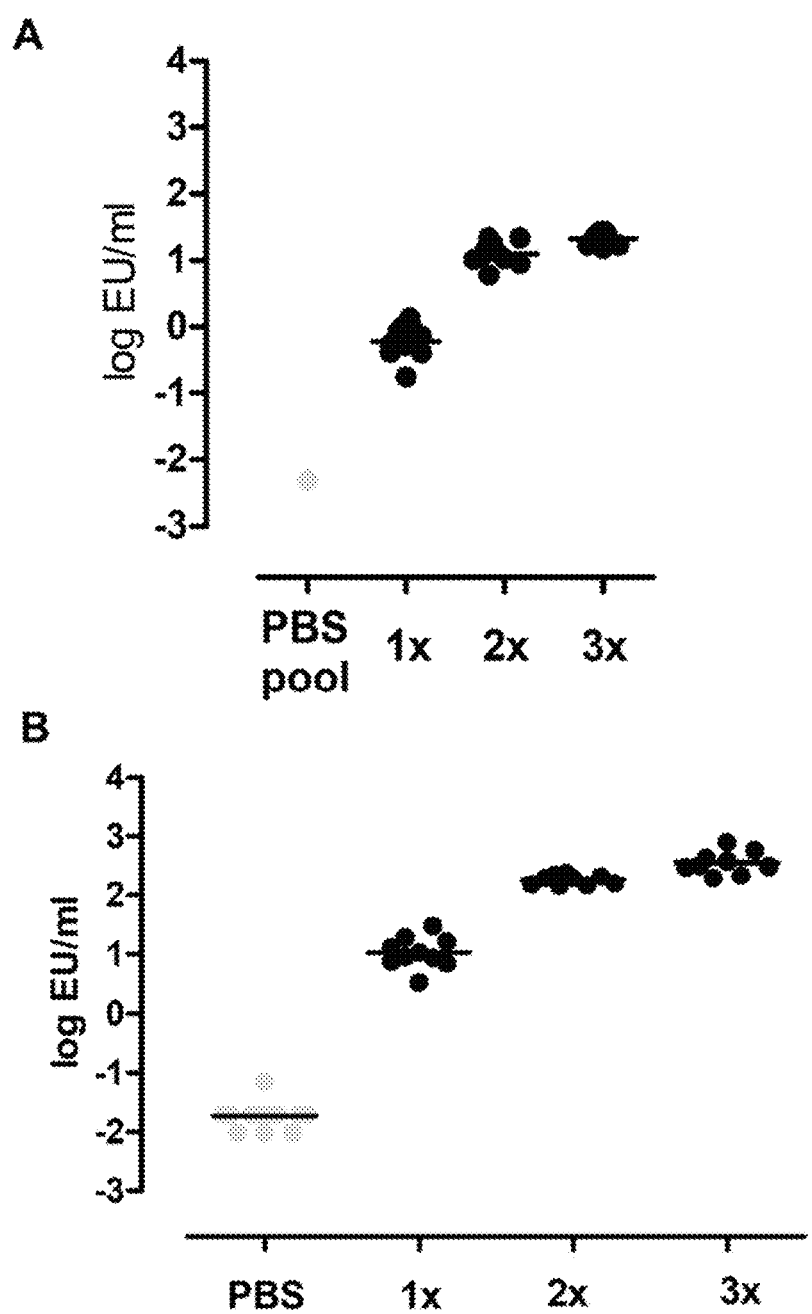

FIG. 14. ELISA results for pre-challenge serum (4 weeks after the final immunization) of the negative control and experimental groups using s127H1-t2-cl18long (A) or a soluble form of Full length HA (B) as the antigen. Bars represent median.

Figure 15:
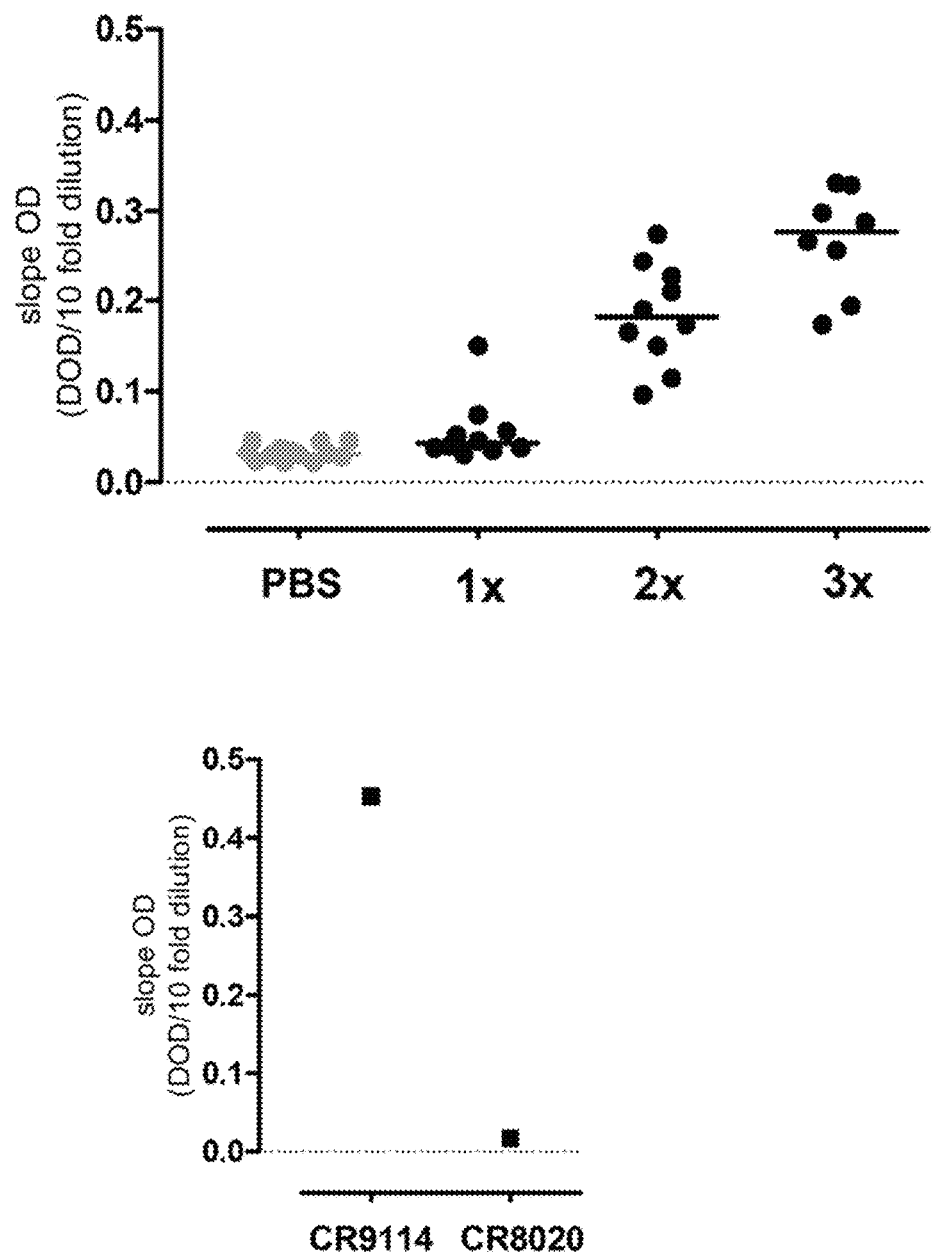
Figure 16A:
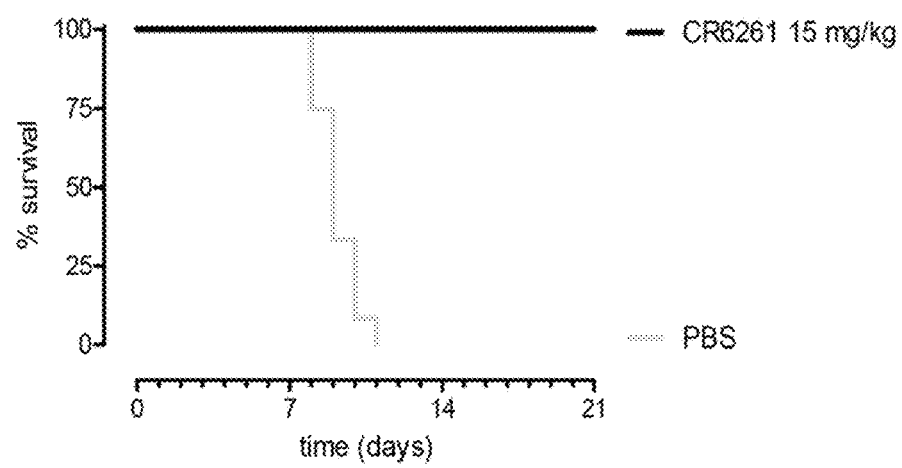
Figure 16B:
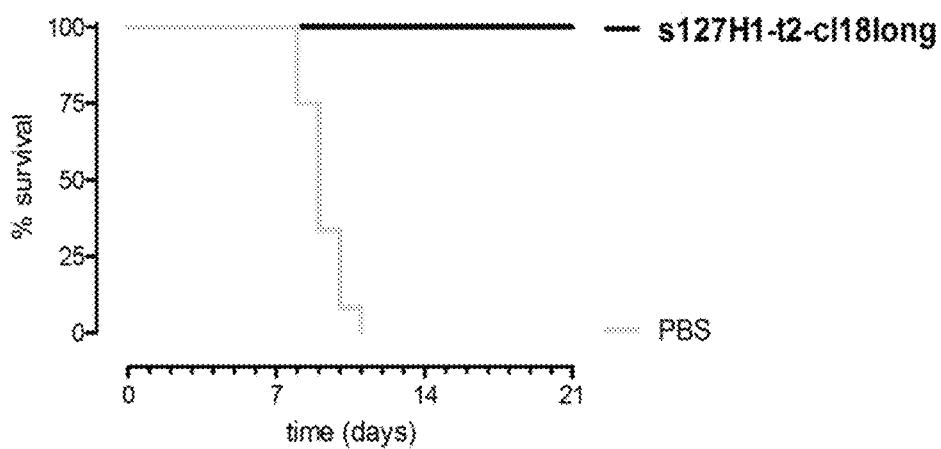
Figure 16C:
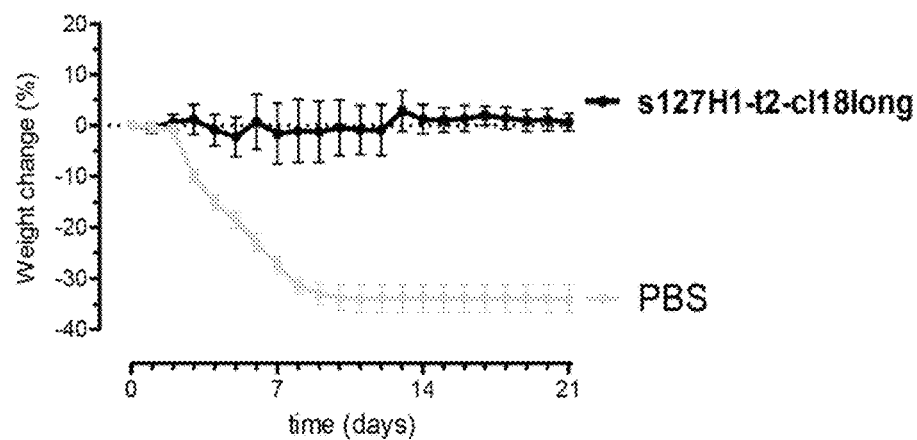
Figure 16D:
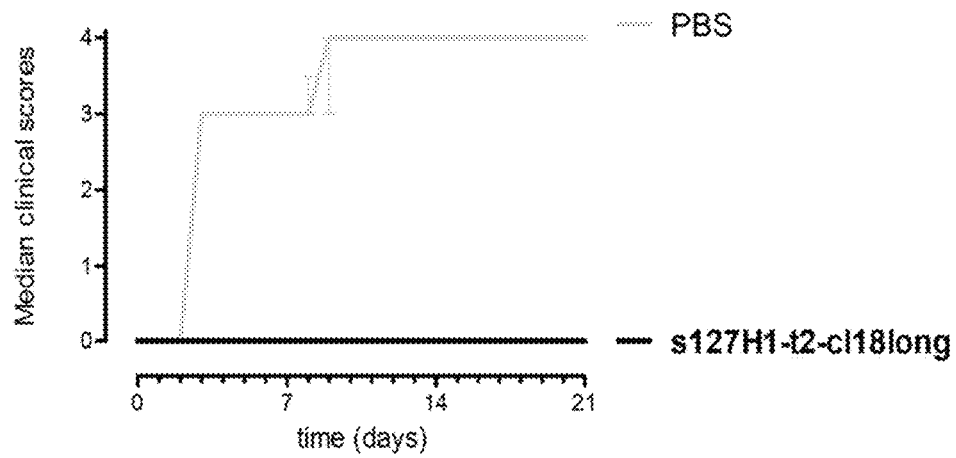

FIG. 15. The antibodies induced 4 weeks after the final immunization (pre-challenge timepoint) after immunization with Matrix-M adjuvated polypeptide of the invention s127H1-t2-cl18long are capable of competing with CR9114 for binding to full length HA from H1N1 A/Brisbane/59/07 in a competition ELISA (top). For reasons of comparison competition levels by unlabeled CR9114 (i.e. self-competition) and the non-binding monoclonal antibodies CR8020, both serially diluted from 5 µg/ml starting concentration, are indicated in a separate graph bottom. Bars represent median.

FIG. 16. (A) Survival for the negative (PBS, 3 immunizations at 3 weeks intervals) and positive control (15 mg/kg CR6261, 1 day before challenge) groups. Mice were challenged four week after the last immunization with a lethal dose (12.5×LD50) of H5N1 A/Hong Kong/156/97. (B) Survival, (C) relative body weight change and (D) median clinical scores for the group immunized 3 times with 30 µg s127H1-t2-cl18long in the presence of 10 µg Matrix-M. Error bars indicate 95% confidence interval (C) or interquartile range (D). Mice were challenged four week after the last immunization with a lethal dose (12.5×LD50) of H5N1 A/Hong Kong/156/97 and monitored for 21 days. For reasons of comparison the negative control group (PBS) is also shown in B, C, D.

Figure 17:
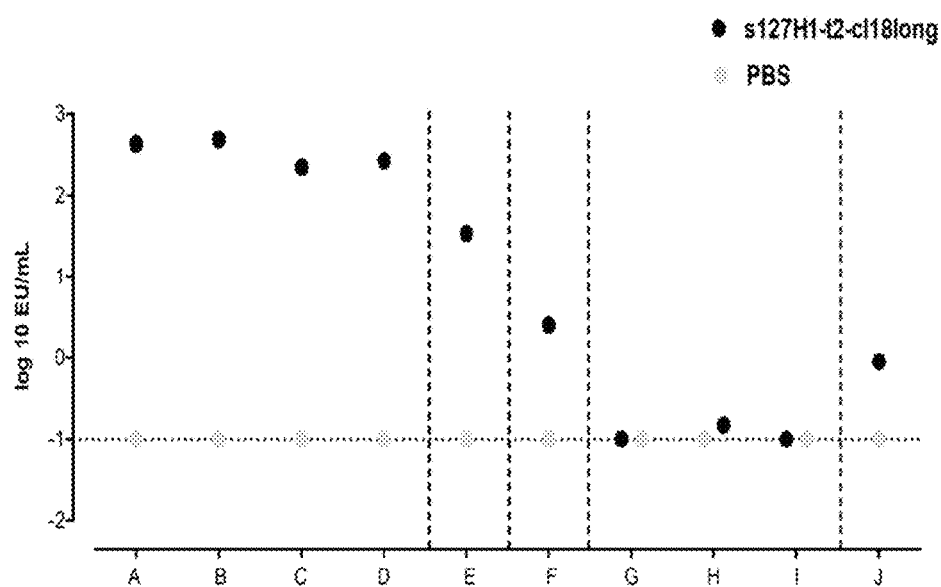
Figure 18A:
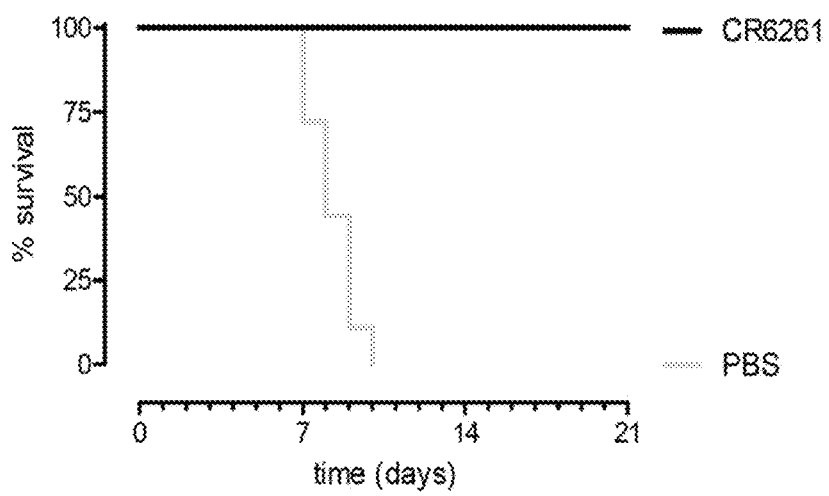
Figure 18B:
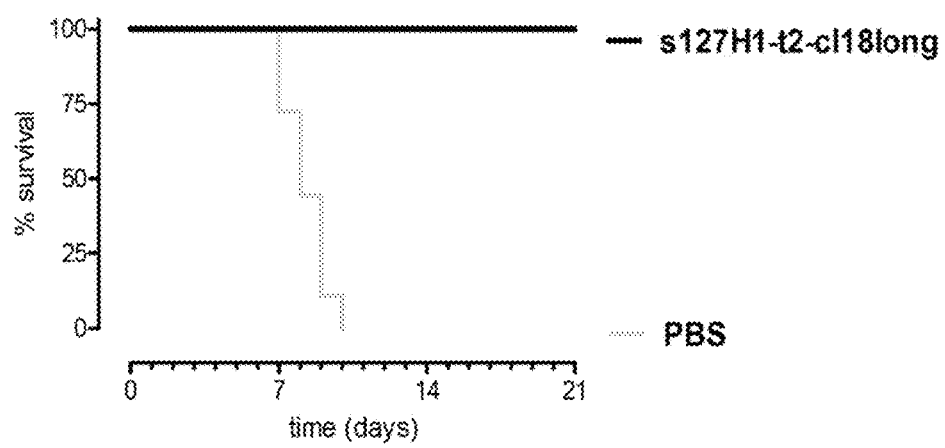
Figure 18C:
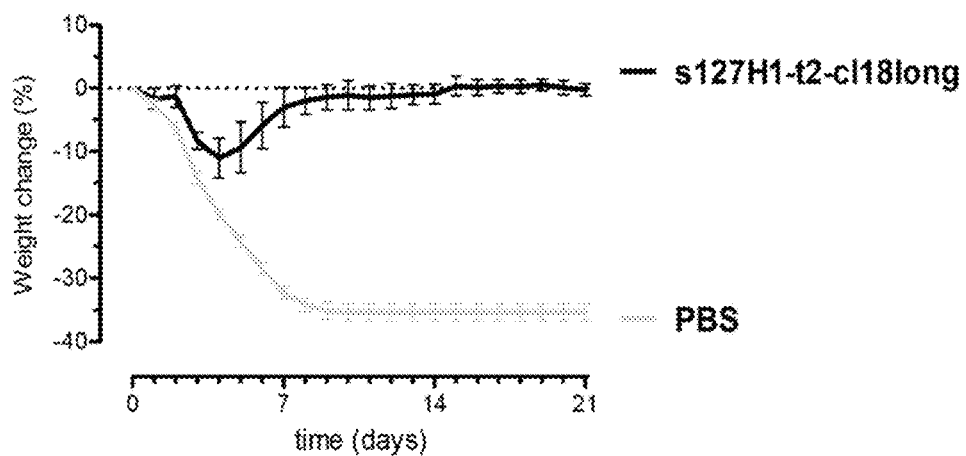
Figure 18D:
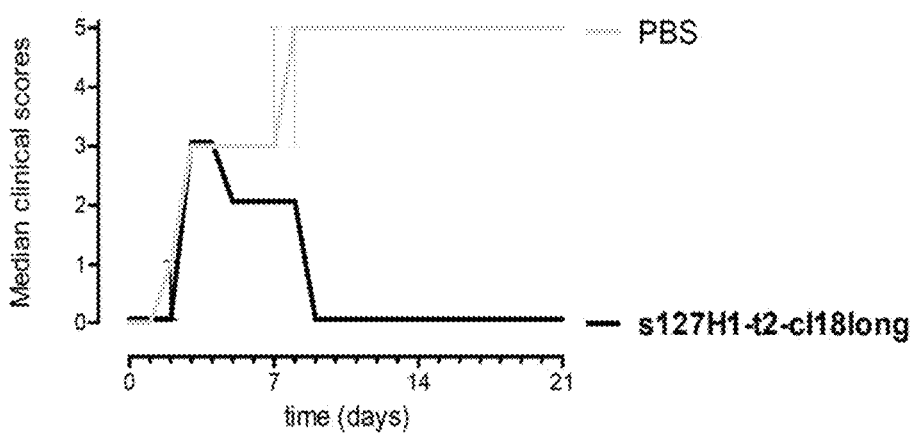

FIG. 17. Elisa results for sera from mice immunized 3 times with polypeptide of the invention s127H1-t2-cl18long as described in example 7 using full length HA's from a number of group 1 (H1, H5 and H9) and group II (H3 and H7) influenza strains as the antigen.

FIG. 18. (A) Survival for the negative (PBS, 3 immunizations at 3 weeks intervals) and positive control (15 mg/kg CR6261, 1 day before challenge) groups. Mice were challenged four week after the last immunization with a lethal dose (12.5×LD50) of H1N1 A/Brisbane/59/2007. (B) Survival, (C) relative body weight change and (D) median clinical scores for the group immunized 3 times with 30 µg s127H1-t2-cl18long in the presence of 10 µg Matrix-M. Error bars indicate 95% confidence interval (C) or interquartile range (D). Mice were challenged four week after the last immunization with a lethal dose (12.5×LD50) of H1N1 A/Brisbane/59/2007 and monitored for 21 days. For reasons of comparison the negative control group (PBS) is also shown in B, C, D.

Figure 19:
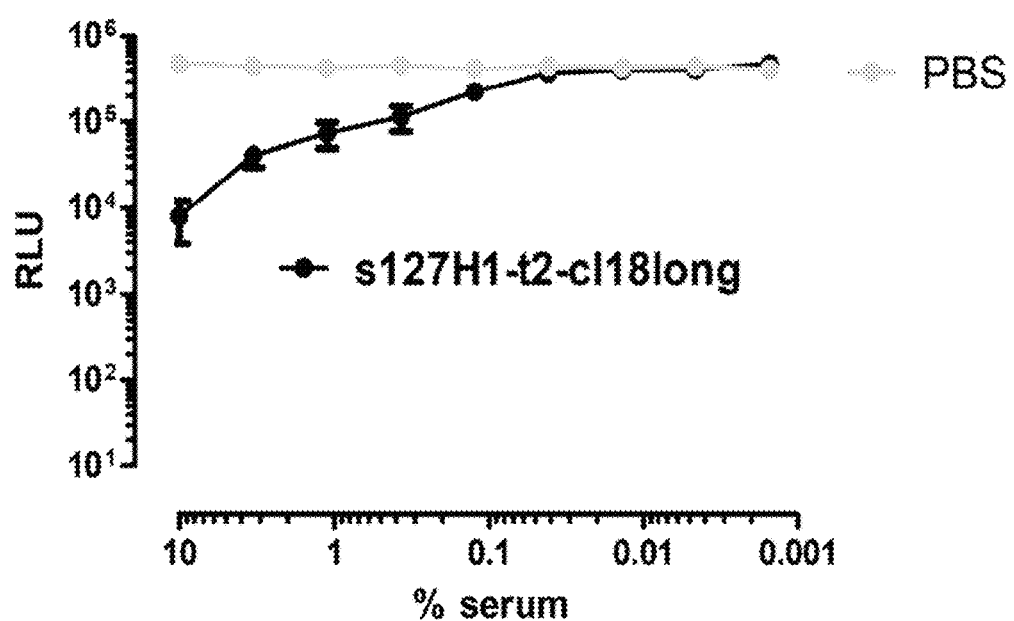

FIG. 19. Pseudoparticle neutralizations assay using sera from mice immunized with polypeptide of the invention s127H1-t2-cl18long or PBS. Neutralization is observed at high serum concentrations for serum from animals immunized with a polypeptide of the invention.

Figure 20A:
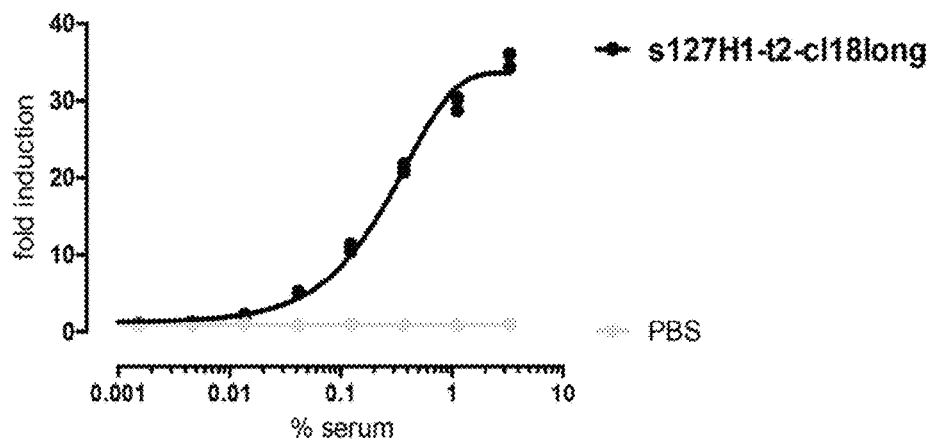
Figure 20B:
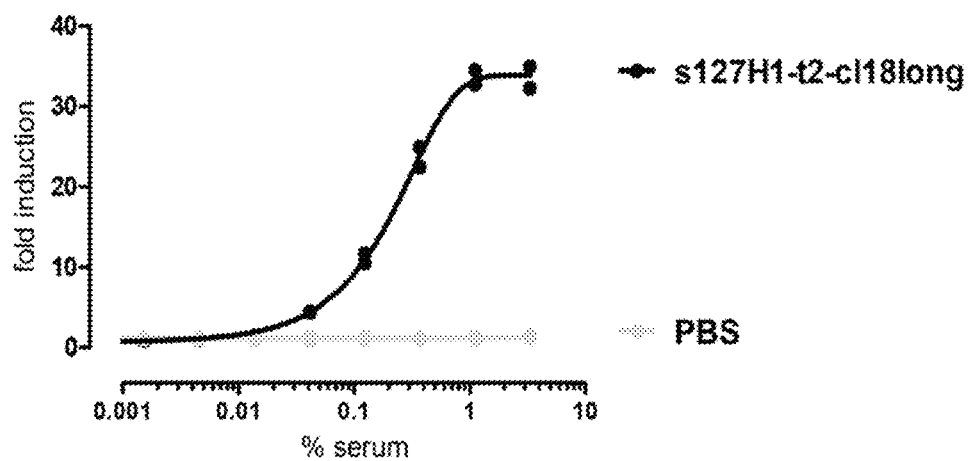

FIG. 20. Antibody Dependent Cellular Cytotoxicity (ADCC) surrogate assay. Sera from mice immunized with polypeptide of the invention s127H1-t2-cl18long exhibit a 30-40 fold induction of FcγRIV signaling activity at the highest serum concentrations using target cells transfected with FL HA from H5N1 A/Hong Kong/156/97 (A) or H1N1 A/Brisbane/59/07 (B) as the source of antigen.

Figure 21:
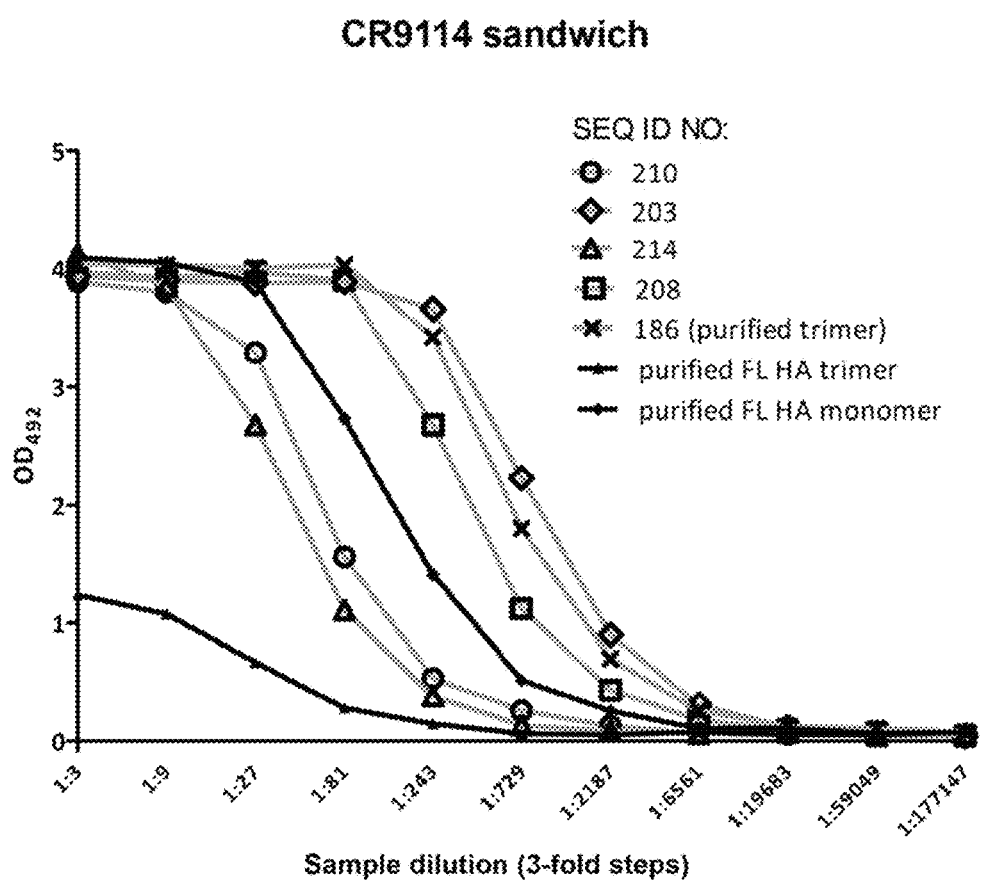
Figure 21:
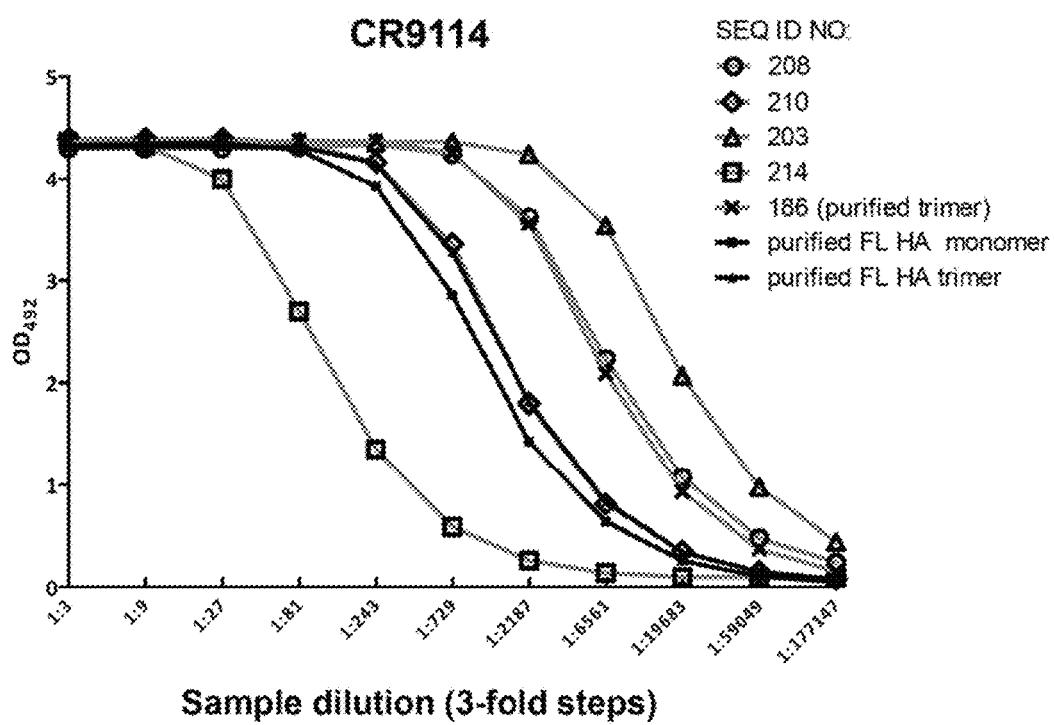
Figure 21:
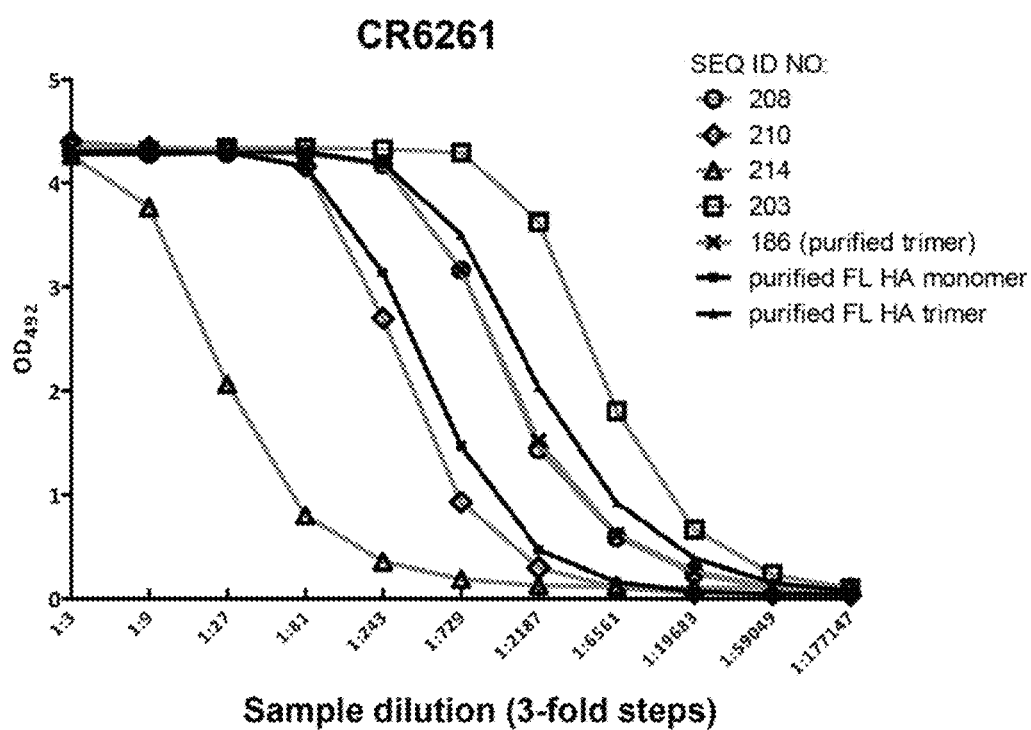
Figure 21:
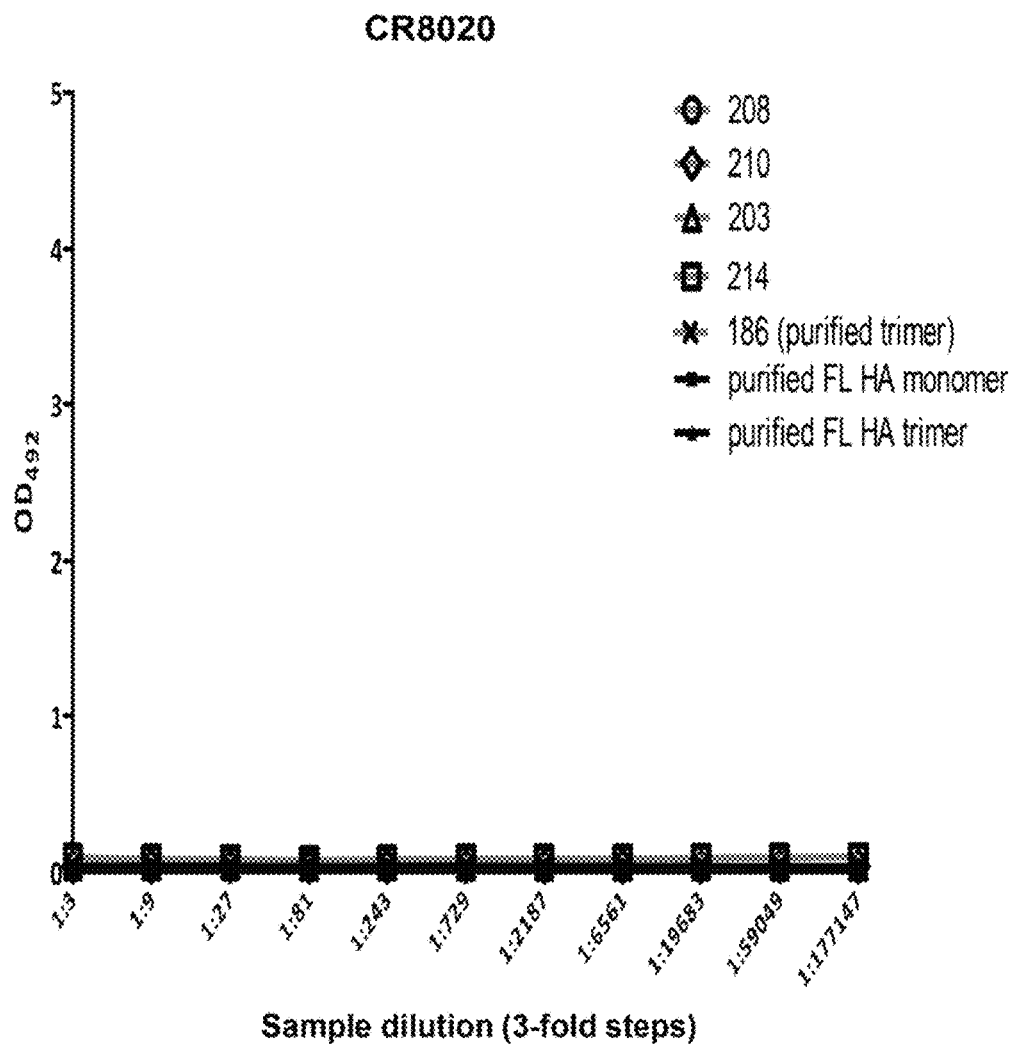

FIG. 21. A: CR9114 sandwich ELISA to detect multimeric forms of polypeptides of the invention (indicated by their SEQ ID NO). Culture medium was diluted in 3 fold steps and analyzed. B: CR9114 binding to polypeptides of the invention (indicated by their SEQ ID NO) by ELISA. Culture medium was diluted in 3 fold steps and analyzed. C: CR6261 binding to polypeptides of the invention (indicated by their SEQ ID NO) by ELISA. Culture medium was diluted in 3 fold steps and analyzed. D: CR8020 binding to polypeptides of the invention (indicated by their SEQ ID NO) by ELISA. Culture medium was diluted in 3 fold steps and analyzed. For the purified proteins (SEQ ID NO: 186 and the Full length HA in trimeric and monomeric form) a starting concentration of 5 μg/ml was used. All polypeptides contain a C-terminal factor X cleavable his tag sequence.

FIG. 22. Western Blot of supernatant of cultures expressing polypeptides of the invention (indicated by their SEQ ID NO) Under reducing conditions the intermonomer disulfide bridges are reduced and the polypeptides of the invention are monomeric on the gel (left panel). Under oxidizing conditions intermonmer disulfide bridges remain intact and the polypeptides of the invention appear as trimers on the gel. For SEQ ID NO: 186 purified trimer was used in this experiment.

FIG. 23. Serum IgG ELISA titers (antigen full length HA) obtained after immunization of NHP as described in example 16. HA's in panel A-F are derived from Group 1 influenza strains (identified in the panels), HA's in panel G-J are derived from Group 2 Influenza strains. Data were analyzed using a slope based weighted average approach. Open symbols denote measurements at LOD. Bars denote medians.

FIG. 24. Serum IgG CR9114 competition binding obtained after immunization of NHP as described in Example 16. FL HA from 3 different strains was used as identified in panel A-C. Data shown are group medians, error bars denote interquartile range.

FIG. 25. Surrogate ADCC activity determined using ADCC Bioassay effector cells in serum obtained after immunization of NHP as described in example 16. Cells transfected with DNA expressing FL HA from 3 different strains was used (identified in panel A-C). Data are expressed as fold induction, which is signal of each measurement compared to background signal in the absence of serum. Lines denote individual animals, symbols denote mean of duplicates per serum concentration.

FIG. 26. Microneutralization assay using serum obtained after immunization of NHP as described in Example 16. Read-out was ELISA based quantification of NP in fixed cells 16 hours after incubation with 100 TCID50 H5N1 A/HK/156/97 per well in the presence of serially diluted serum. Lines denote individual animals, symbols denote mean of duplicates per serum concentration.

FIG. 27. Area under the curve temperature increase of non-human primates included in the experiment described in Example 16. Per animal, a reference 24-hour body temperature cycle was reconstructed using an 21-day window prior to start of the immunizations. The net increase in body temperature during the 21 day post-challenge follow-up period was calculated by subtracting the reference body temperature with added upper limit of the 95% CI from the body temperature measured during the post-challenge follow-up period. The AUC of the net temperature increase was subsequently calculated at intervals of day 0-3, day 0-8 and day 0-21. Statistical analysis between treatments was performed using pairwise t-test with Tukey-Kramer adjustment for multiple comparisons. Bars denote median. No data animal J10014 (SEQ ID NO: 186+Matrix-M group) due to data logger failure. Animal Ji0403061 (Inflexal group) died at the end of day 8 and was excluded from the day 0-21 interval calculation.

Figure 28:
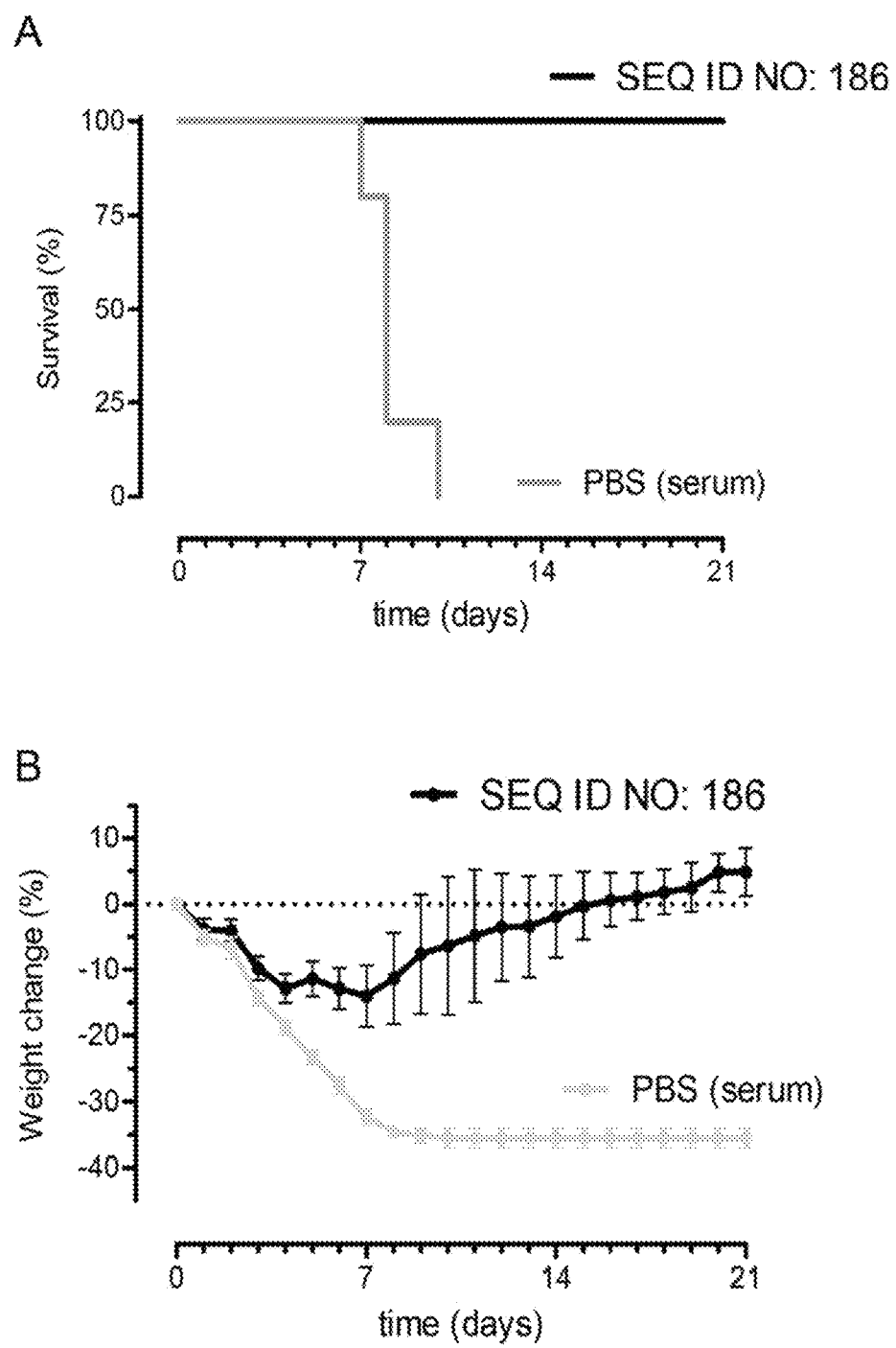

FIG. 28. Survival (A) and % body weight change (B) of mice after serum transfer and challenge with H5N1 A/Hong Kong/156/97 as described in Example 17.

Figure 29:
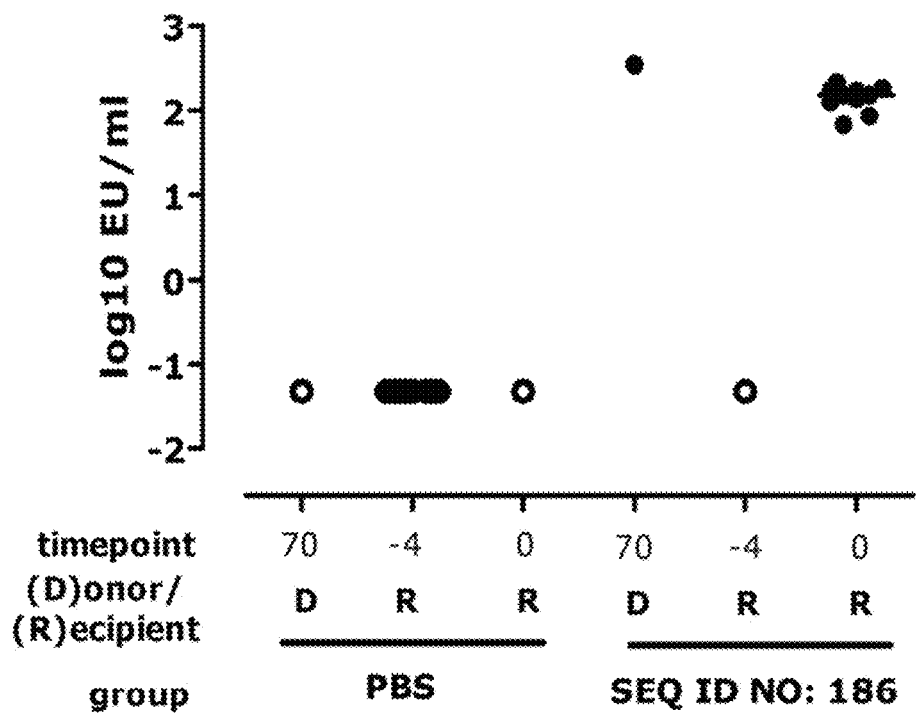

FIG. 29. Full length HA (H1N1 A/Brisbane/59/2007) ELISA titers of donor mice (D) at day 70, and recipient mice (R) prior to serum transfer (day −4) or challenge (day 0). Data were analyzed using a slope based weighted average approach. Open symbols denote measurements at LOD. Bars denote medians.

Figure 30:
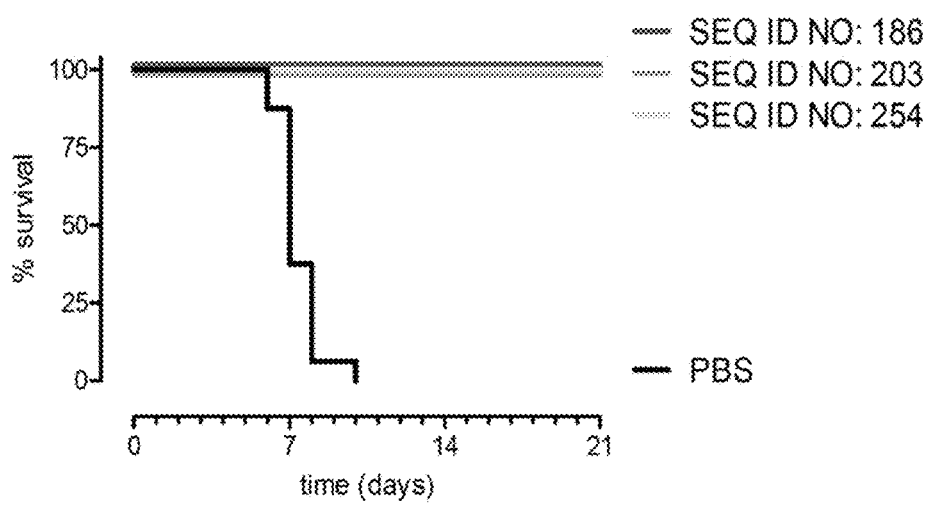
Figure 30:
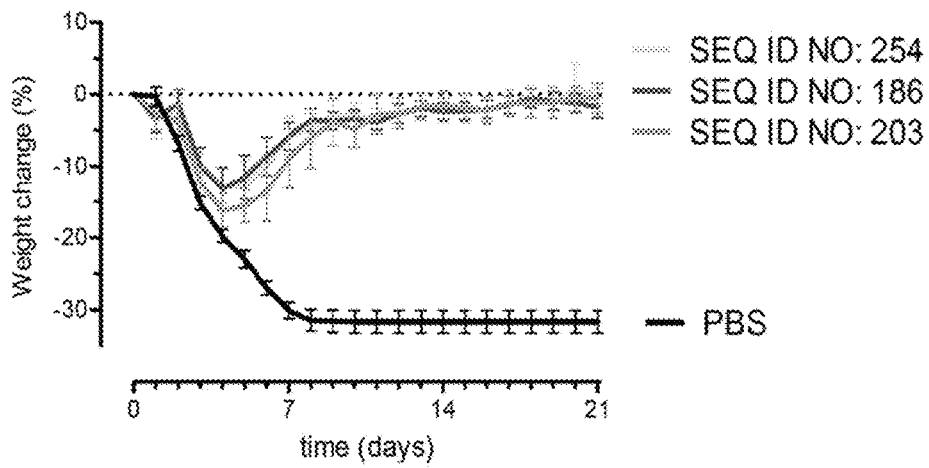

FIG. 30. Survival (A) and % body weight change (B) of mice after immunization and challenge with H1N1 A/Brisbane/59/2007 as described in Example 18.

Figure 31:
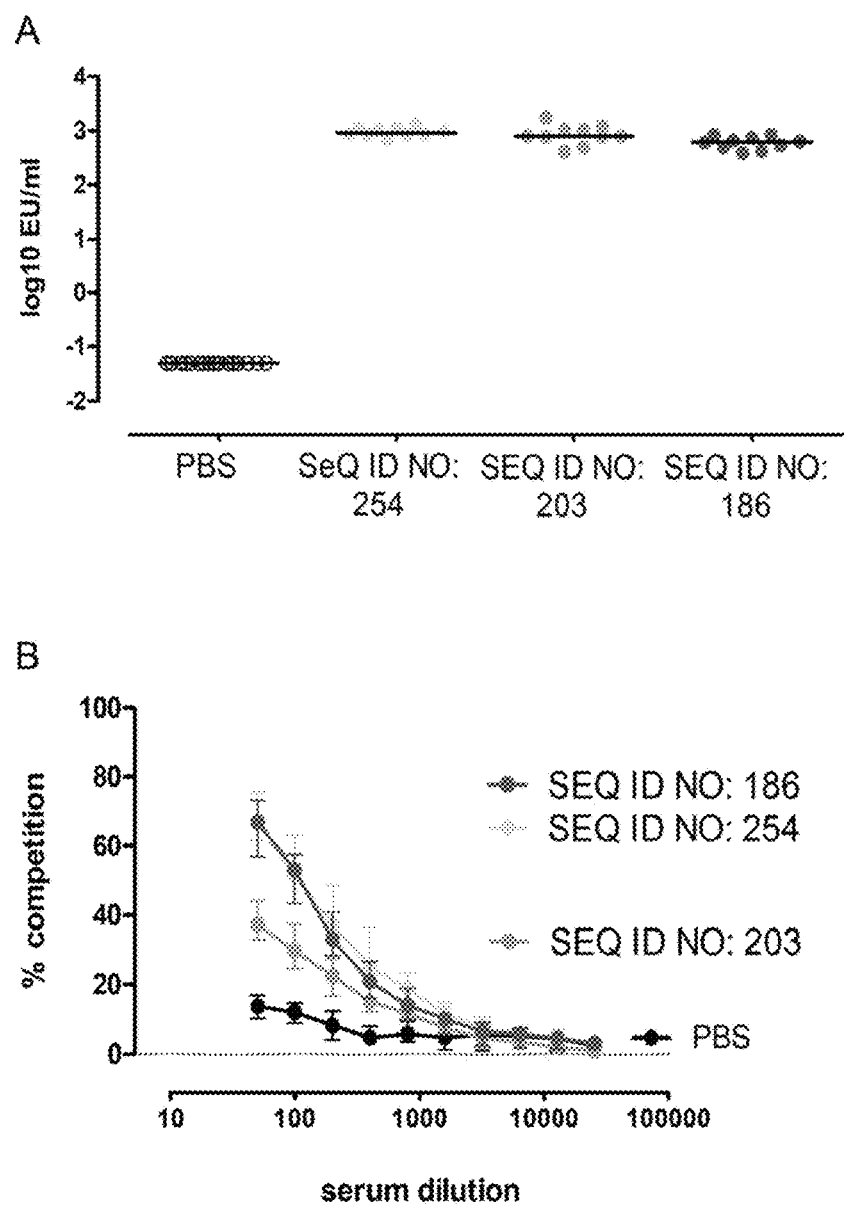

FIG. 31. A: Full length HA (H1N1 A/Brisbane/59/2007) ELISA titers of mice immunized as described in Example 18. Data were analyzed using a slope based weighted average approach. Open symbols denote measurements at LOD. Bars denote medians. B: Serum IgG CR9114 competition binding obtained after immunization mice as described in Example 18. FL HA from H1N1 A/Brisbane/59/2007 was used as the antigen. Data shown are group medians, error bars denote interquartile range.

Figure 32:
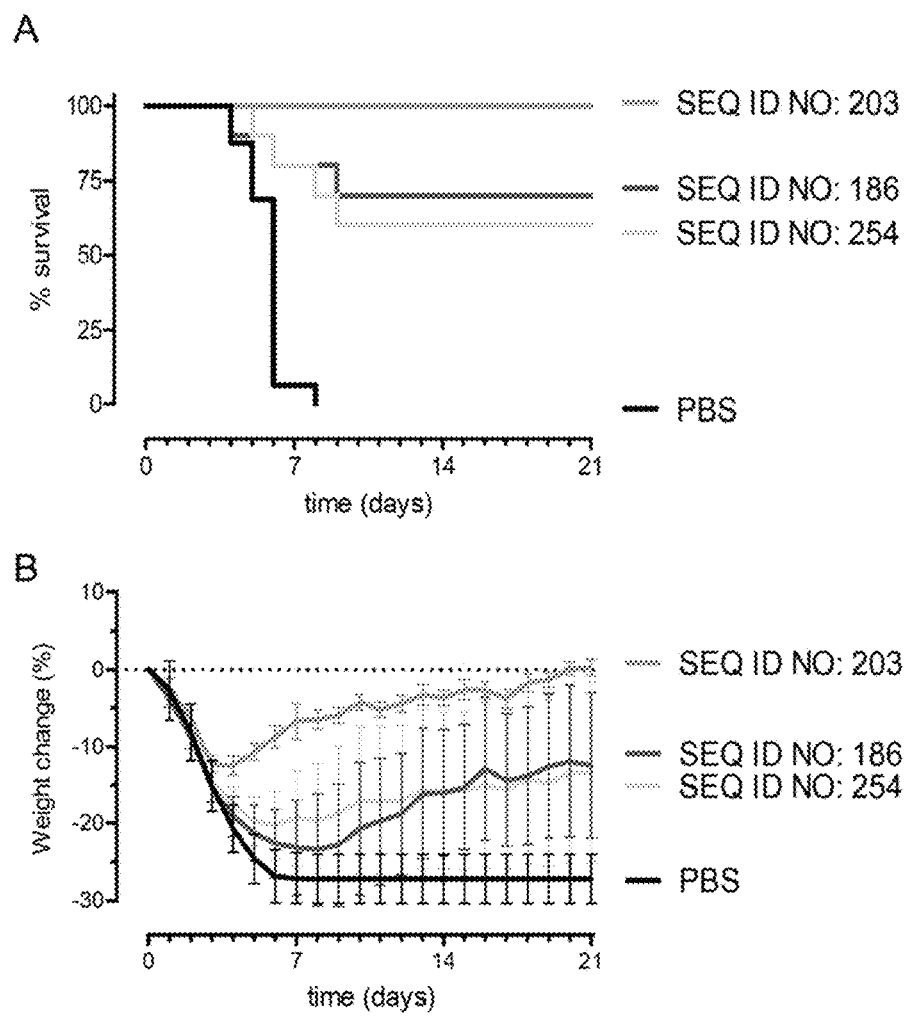

FIG. 32. Survival (A) and % body weight change (B) of mice after immunization and challenge with H1N1 A/Netherlands/602/09 as described in Example 19.

Figure 33:
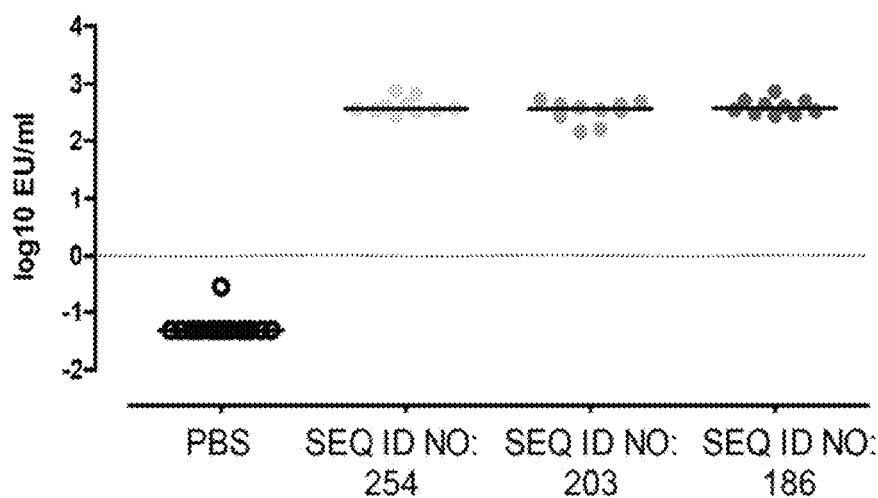
Figure 33:
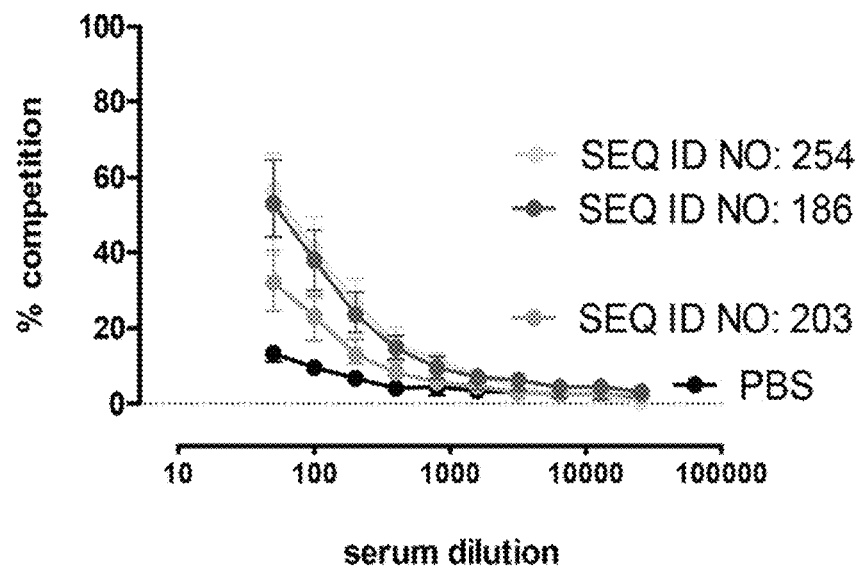

FIG. 33. A: Full length HA (H1N1 A/Brisbane/59/2007) ELISA titers of mice immunized as described in Example 19. Data were analyzed using a slope based weighted average approach. Open symbols denote measurements at LOD. Bars denote medians. B: Serum IgG CR9114 competition binding obtained after immunization mice as described in example 19. FL HA from H1N1 A/Brisbane/59/2007 was used as the antigen. Data shown are group medians, error bars denote interquartile range.

Figure 34:
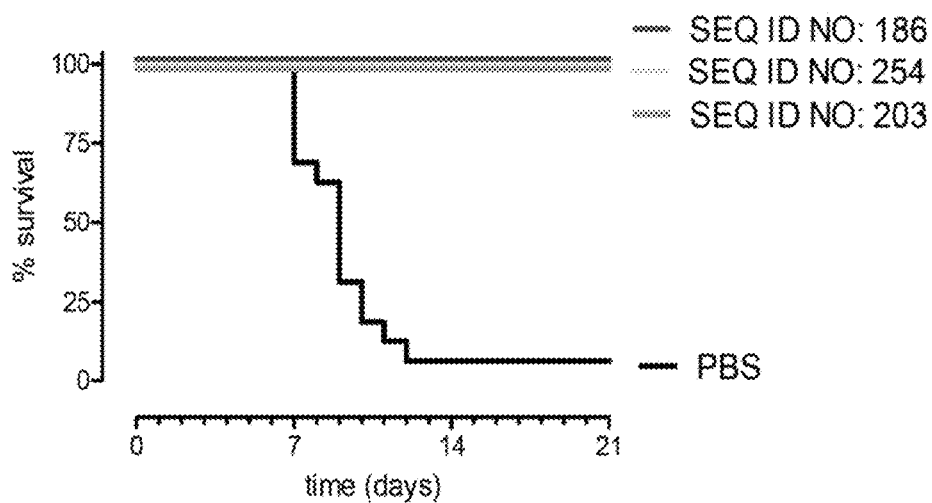
Figure 34:
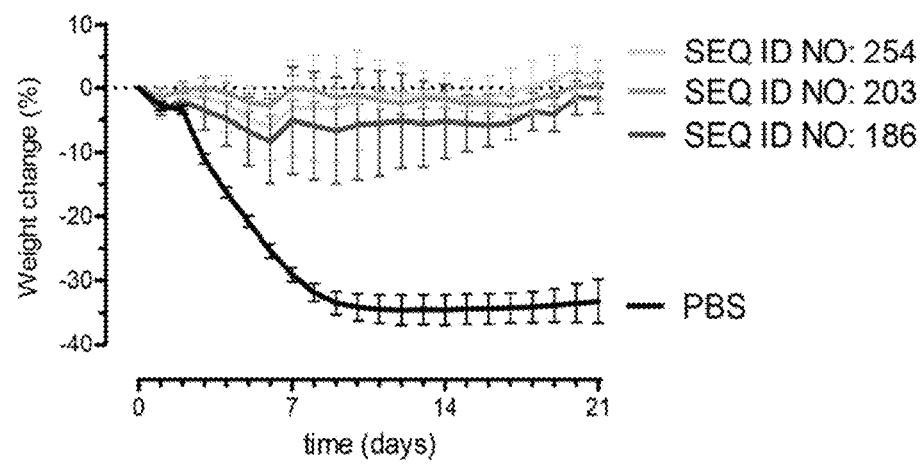

FIG. 34. Survival (A) and % body weight change (B) of mice after immunization and challenge with H5N1 A/Hong Kong/156/97 as described in Example 20.

Figure 35:
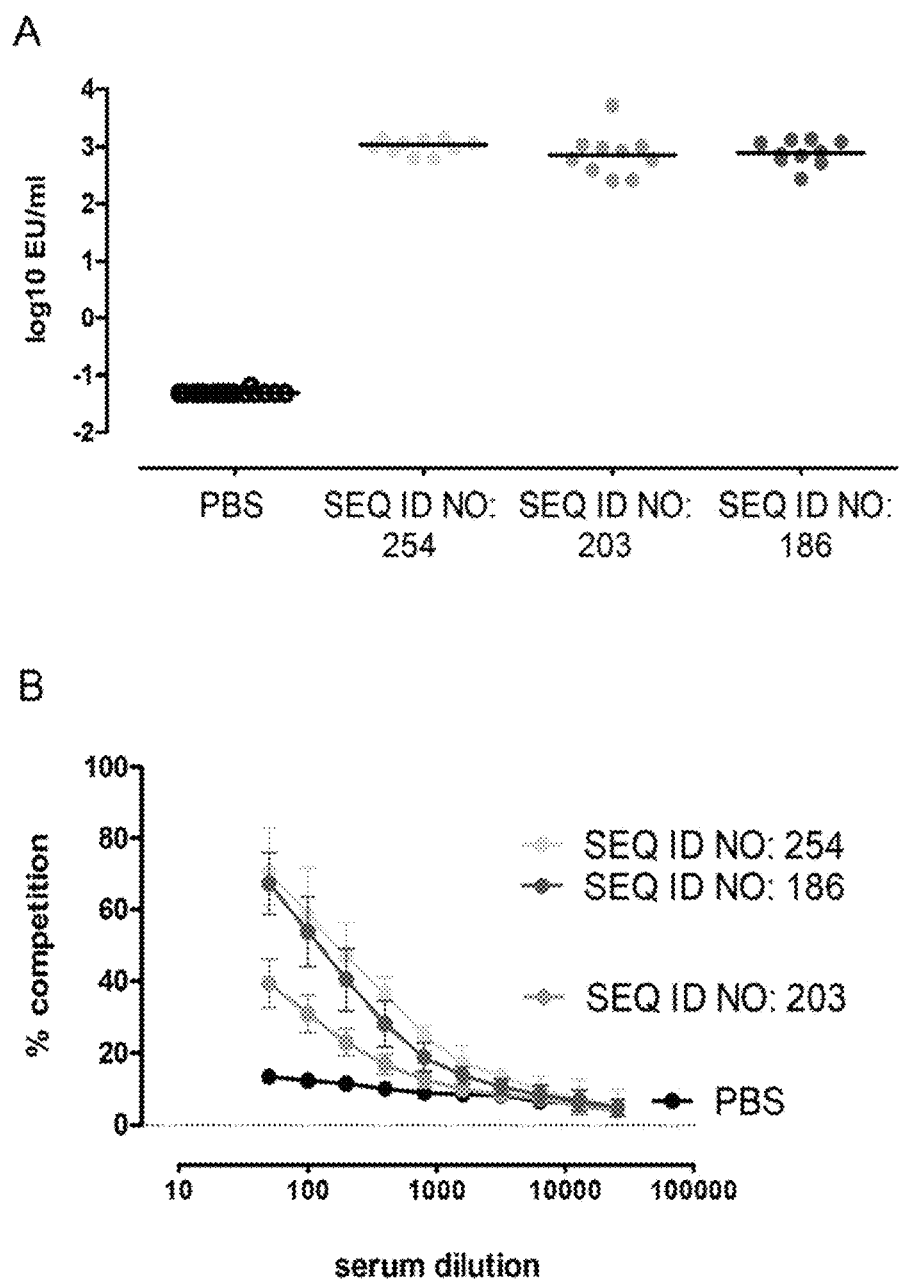

FIG. 35. A: Full length HA (H1N1 A/Brisbane/59/2007) ELISA titers of mice immunized as described in Example 20. Data were analyzed using a slope based weighted average approach. Open symbols denote measurements at LOD. Bars denote medians. B: Serum IgG CR9114 competition binding obtained after immunization mice as described in Example 20. FL HA from H1N1 A/Brisbane/59/2007 was used as the antigen. Data shown are group medians, error bars denote interquartile range.

Figure 36:
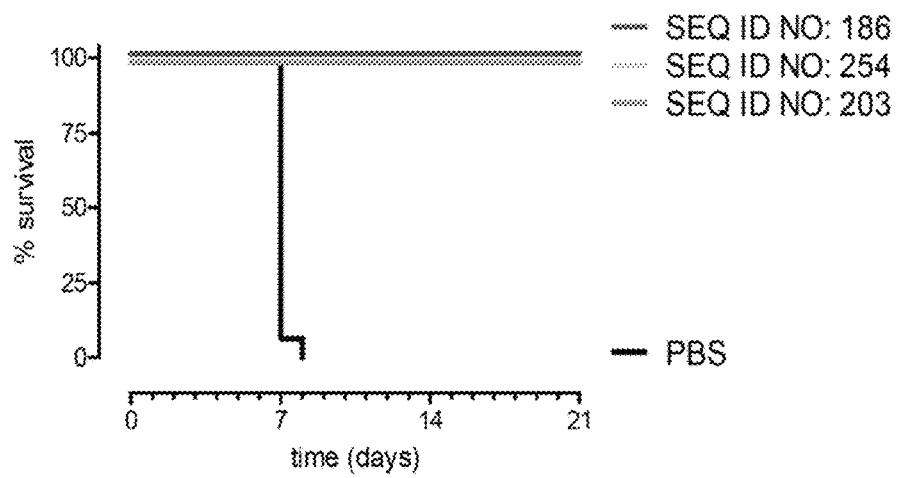
Figure 36:
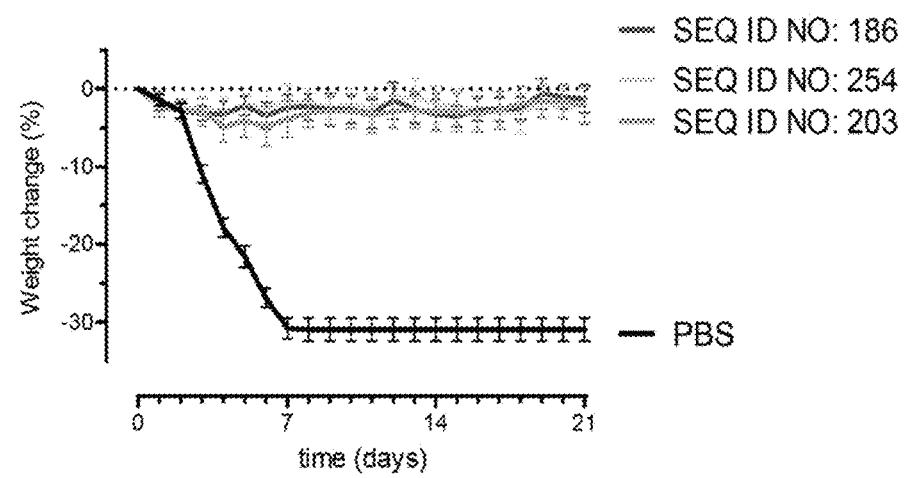

FIG. 36. Survival (A) and % body weight change (B) of mice after immunization and challenge with H1N1 A/Puerto Rico/8/34 as described in Example 21.

Figure 37:
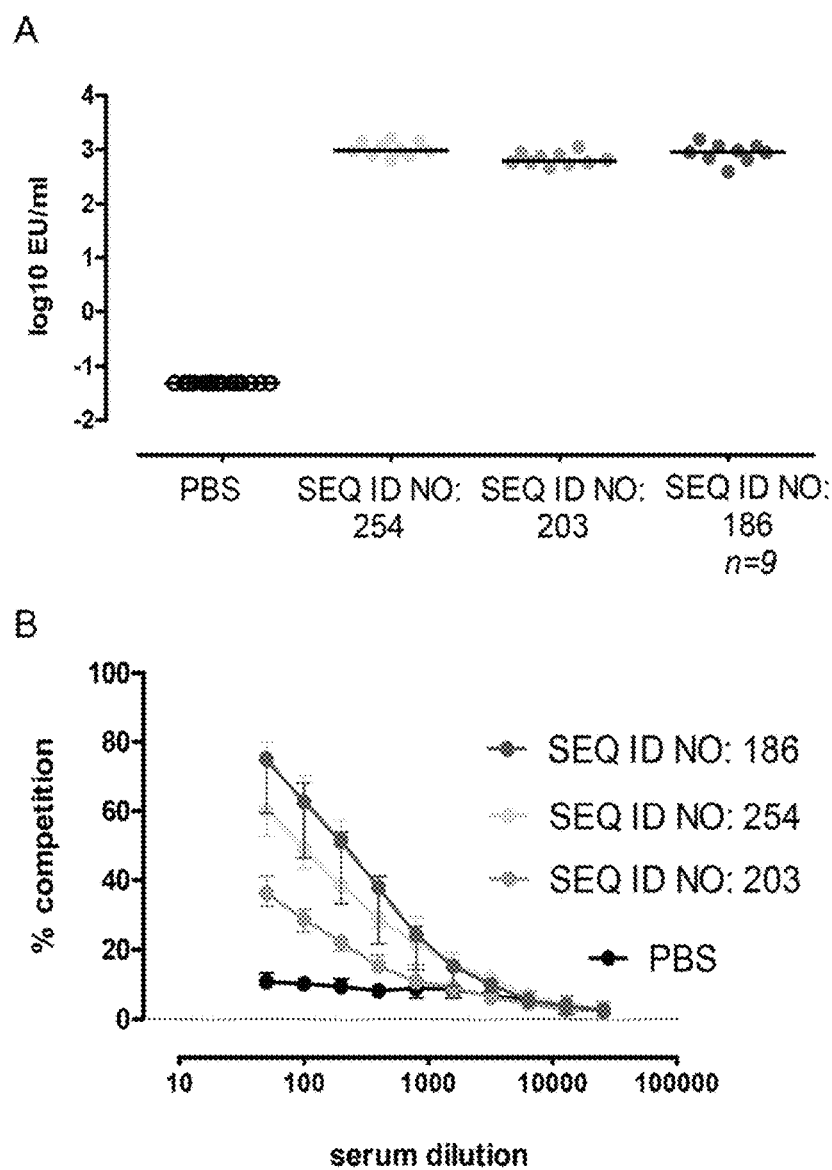

FIG. 37. A: Full length HA (H1N1 A/Brisbane/59/2007) ELISA titers of mice immunized as described in Example 21. Data were analyzed using a slope based weighted average approach. Open symbols denote measurements at LOD. Bars denote medians. B: Serum IgG CR9114 competition binding obtained after immunization mice as described in Example 21. FL HA from H1N1 A/Brisbane/59/2007 was used as the antigen. Data shown are group medians, error bars denote interquartile range.

Figure 38:
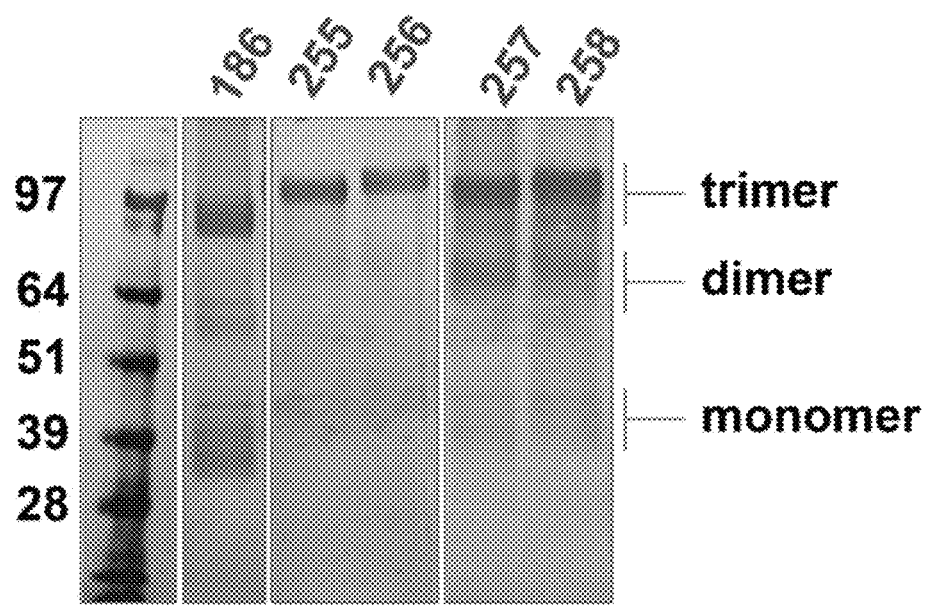

FIG. 38: Western Blot (polyclonal anti H1) of Hek293F cell culture supernatant after transient transfection with polypeptides of the invention.

DEFINITIONS

Definitions of terms as used in the present invention are given below.

An amino acid according to the invention can be any of the twenty naturally occurring (or 'standard' amino acids) or variants thereof, such as e.g. D-proline (the D-enantiomer of proline), or any variants that are not naturally found in proteins, such as e.g. norleucine. The standard amino acids can be divided into several groups based on their properties. Important factors are charge, hydrophilicity or hydrophobicity, size and functional groups. These properties are important for protein structure and protein-protein interactions. Some amino acids have special properties such as cysteine, that can form covalent disulfide bonds (or disulfide bridges) to other cysteine residues, proline that forms a cycle to the polypeptide backbone, and glycine that is more flexible than other amino acids. Table 1 shows the abbreviations and properties of the standard amino acids.

The term "amino acid sequence identity" refers to the degree of identity or similarity between a pair of aligned amino acid sequences, usually expressed as a percentage. Percent identity is the percentage of amino acid residues in a candidate sequence that are identical (i.e., the amino acid residues at a given position in the alignment are the same residue) or similar (i.e., the amino acid substitution at a given position in the alignment is a conservative substitution, as discussed below), to the corresponding amino acid residue in the peptide after aligning the sequences and introducing gaps, if necessary, to achieve the maximum percent sequence homology. Sequence homology, including percentages of sequence identity and similarity, are determined using sequence alignment techniques well-known in the art, such as by visual inspection and mathematical calculation, or more preferably, the comparison is done by comparing sequence information using a computer program. An exemplary, preferred computer program is the Genetics Computer Group (GCG; Madison, Wis.) Wisconsin package version 10.0 program, 'GAP' (Devereux et al. (1984)).

"Conservative substitution" refers to replacement of an amino acid of one class is with another amino acid of the same class. In particular embodiments, a conservative substitution does not alter the structure or function, or both, of a polypeptide. Classes of amino acids for the purposes of conservative substitution include hydrophobic (e.g. Met, Ala, Val, Leu), neutral hydrophilic (e.g. Cys, Ser, Thr), acidic (e.g. Asp, Glu), basic (e.g. Asn, Gin, His, Lys, Arg), conformation disrupters (e.g. Gly, Pro) and aromatic (e.g. Trp, Tyr, Phe).

As used herein, the terms "disease" and "disorder" are used interchangeably to refer to a condition in a subject. In some embodiments, the condition is a viral infection, in particular an influenza virus infection. In specific embodiments, a term "disease" refers to the pathological state resulting from the presence of the virus in a cell or a subject, or by the invasion of a cell or subject by the virus. In certain embodiments, the condition is a disease in a subject, the severity of which is decreased by inducing an immune response in the subject through the administration of an immunogenic composition.

As used herein, the term "effective amount" in the context of administering a therapy to a subject refers to the amount of a therapy which has a prophylactic and/or therapeutic effect(s). In certain embodiments, an "effective amount" in the context of administration of a therapy to a subject refers to the amount of a therapy which is sufficient to achieve a reduction or amelioration of the severity of an influenza virus infection, disease or symptom associated therewith, such as, but not limited to a reduction in the duration of an influenza virus infection, disease or symptom associated therewith, the prevention of the progression of an influenza virus infection, disease or symptom associated therewith, the prevention of the development or onset or recurrence of an influenza virus infection, disease or symptom associated therewith, the prevention or reduction of the spread of an influenza virus from one subject to another subject, the reduction of hospitalization of a subject and/or hospitalization length, an increase of the survival of a subject with an influenza virus infection or disease associated therewith, elimination of an influenza virus infection or disease associated therewith, inhibition or reduction of influenza virus replication, reduction of influenza virus titer; and/or enhancement and/or improvement of the prophylactic or therapeutic effect(s) of another therapy. In certain embodiments, the effective amount does not result in complete protection from an influenza virus disease, but results in a lower titer or reduced number of influenza viruses compared to an untreated subject. Benefits of a reduction in the titer, number or total burden of influenza virus include, but are not limited to, less severe symptoms of the infection, fewer symptoms of the infection and a reduction in the length of the disease associated with the infection.

The term "host", as used herein, is intended to refer to an organism or a cell into which a vector such as a cloning vector or an expression vector has been introduced. The organism or cell can be prokaryotic or eukaryotic. Preferably, the host comprises isolated host cells, e.g. host cells in culture. The term "host cells" merely signifies that the cells are modified for the (over)-expression of the polypeptides of the invention. It should be understood that the term host is intended to refer not only to the particular subject organism or cell but to the progeny of such an organism or cell as well. Because certain modifications may occur in succeeding generations due to either mutation or environmental influences, such progeny may not, in fact, be identical to the parent organism or cell, but are still included within the scope of the term "host" as used herein.

The term "included" or "including" as used herein is deemed to be followed by the words "without limitation".

As used herein, the term "infection" means the invasion by, multiplication and/or presence of a virus in a cell or a subject. In one embodiment, an infection is an "active" infection, i.e., one in which the virus is replicating in a cell or a subject. Such an infection is characterized by the spread of the virus to other cells, tissues, and/or organs, from the cells, tissues, and/or organs initially infected by the virus. An infection may also be a latent infection, i.e., one in which the virus is not replicating. In certain embodiments, an infection refers to the pathological state resulting from the presence of the virus in a cell or a subject, or by the invasion of a cell or subject by the virus.

Influenza viruses are classified into influenza virus types: genus A, B and C. The term "influenza virus subtype" as used herein refers to influenza A virus variants that are characterized by combinations of the hemagglutinin (H) and neuramidase (N) viral surface proteins. According to the present invention influenza virus subtypes may be referred to by their H number, such as for example "influenza virus comprising HA of the H3 subtype", "influenza virus of the H3 subtype" or "H3 influenza", or by a combination of a H number and an N number, such as for example "influenza virus subtype H3N2" or "H3N2". The term "subtype" specifically includes all individual "strains", within each subtype, which usually result from mutations and show different pathogenic profiles, including natural isolates as well as man-made mutants or reassortants and the like. Such strains may also be referred to as various "isolates" of a viral subtype. Accordingly, as used herein, the terms "strains" and "isolates" may be used interchangeably. The current nomenclature for human influenza virus strains or isolates includes the type (genus) of virus, i.e. A, B or C, the geographical location of the first isolation, strain number and year of isolation, usually with the antigenic description of HA and NA given in brackets, e.g. A/Moscow/10/00 (H3N2). Non-human strains also include the host of origin in the nomenclature. The influenza A virus subtypes can further be classified by reference to their phylogenetic group. Phylogenetic analysis has demonstrated a subdivision of hemagglutinins into two main groups: inter alia the H1, H2, H5 and H9 subtypes in phylogenetic group 1 ("group 1" influenza viruses) and inter alia the H3, H4, H7 and H10 subtypes in phylogenetic group 2 ("group 2" influenza viruses).

As used herein, the term "influenza virus disease" refers to the pathological state resulting from the presence of an influenza virus, e.g. an influenza A or B virus in a cell or subject or the invasion of a cell or subject by an influenza virus. In specific embodiments, the term refers to a respiratory illness caused by an influenza virus.

As used herein, the term "nucleic acid" is intended to include DNA molecules (e.g., cDNA or genomic DNA) and RNA molecules (e.g., mRNA) and analogs of the DNA or RNA generated using nucleotide analogs. The nucleic acid can be single-stranded or double-stranded. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). A reference to a nucleic acid sequence encompasses its complement unless otherwise specified. Thus, a reference to a nucleic acid molecule having a particular sequence should be understood to encompass its complementary strand, with its complementary sequence. The complementary strand is also useful, e.g., for anti-sense therapy, hybridization probes and PCR primers.

As used herein, in certain embodiments the numbering of the amino acids in HA is based on the numbering of amino acids in HA0 of a wild type influenza virus, e.g. the numbering of the amino acids of the H1N1 influenza strain A/Brisbane/59/2007 (SEQ ID NO: 1). As used in the present invention, the wording "the amino acid at position "x" in HA" thus means the amino acid corresponding to the amino acid at position x in HA0 of the particular wild type influenza virus, e.g. A/Brisbane/59/2007 (SEQ ID NO: 1; wherein the amino acids of the HA2 domain have been indicated in italics). It will be understood by the skilled person that equivalent amino acids in other influenza virus strains and/or subtypes can be determined by multiple sequence alignment. Note that, in the numbering system used throughout this application 1 refers to the N-terminal amino acid of an immature HA0 protein (SEQ ID NO: 1). The mature sequence starts e.g. on position 18 of SEQ ID NO: 1. It will be understood by the skilled person that the leader sequence (or signal sequence) that directs transport of a protein during production (e.g. corresponding to amino acids 1-17 of SEQ ID NO: 1), generally is not present in the final polypeptide, that is e.g. used in a vaccine. In certain embodiments, the polypeptides according to the invention thus comprise an amino acid sequence without the leader sequence, i.e. the amino acid sequence is based on the amino acid sequence of HA0 without the signal sequence.

"Polypeptide" refers to a polymer of amino acids linked by amide bonds as is known to those of skill in the art. As used herein, the term can refer to a single polypeptide chain linked by covalent amide bonds. The term can also refer to multiple polypeptide chains associated by non-covalent interactions such as ionic contacts, hydrogen bonds, Van der Waals contacts and hydrophobic contacts. Those of skill in the art will recognize that the term includes polypeptides that have been modified, for example by post-translational processing such as signal peptide cleavage, disulfide bond formation, glycosylation (e.g., N-linked and O-linked glycosylation), protease cleavage and lipid modification (e.g. S-palmitoylation).

"Stem domain polypeptide" refers to a polypeptide that comprises one or more polypeptide chains that make up a stem domain of a naturally-occurring (or wild-type) hemagglutinin (HA). Typically, a stem domain polypeptide is a single polypeptide chain (i.e. corresponding to the stem domain of a hemagglutinin HA0 polypeptide) or two polypeptide chains (i.e. corresponding to the stem domain of a hemagglutinin HA1 polypeptide in association with a hemagglutinin HA2 polypeptide). According to the invention, a stem domain polypeptide comprises one or more mutations as compared to the wild-type HA molecule, in particular one or more amino acid residues of the wild-type HA may have been substituted by other amino acids, not naturally occurring on the corresponding position in a particular wild-type HA. Stem domain polypeptides according to the invention can furthermore comprise one or more linking sequences, as described below.

The term "vector" denotes a nucleic acid molecule into which a second nucleic acid molecule can be inserted for introduction into a host where it will be replicated, and in some cases expressed. In other words, a vector is capable of transporting a nucleic acid molecule to which it has been linked. Cloning as well as expression vectors are contemplated by the term "vector", as used herein. Vectors include, but are not limited to, plasmids, cosmids, bacterial artificial chromosomes (BAC) and yeast artificial chromosomes (YAC) and vectors derived from bacteriophages or plant or animal (including human) viruses. Vectors comprise an origin of replication recognized by the proposed host and in case of expression vectors, promoter and other regulatory regions recognized by the host. Certain vectors are capable of autonomous replication in a host into which they are introduced (e.g., vectors having a bacterial origin of replication can replicate in bacteria). Other vectors can be integrated into the genome of a host upon introduction into the host, and thereby are replicated along with the host genome. As used herein, the term "wild-type" in the context of a virus refers to influenza viruses that are prevalent, circulating naturally and producing typical outbreaks of disease.

DETAILED DESCRIPTION

Influenza viruses have a significant impact on global public health, causing millions of cases of severe illness each year, thousands of deaths, and considerable economic losses. Current trivalent influenza vaccines elicit a potent neutralizing antibody response to the vaccine strains and closely related isolates, but rarely extend to more diverged strains within a subtype or to other subtypes. In addition, selection of the appropriate vaccine strains presents many challenges and frequently results in sub-optimal protection. Furthermore, predicting the subtype of the next pandemic virus, including when and where it will arise, is currently impossible.

Hemagglutinin (HA) is the major envelope glycoprotein from influenza A viruses which is the major target of neutralizing antibodies. Hemagglutinin has two main functions during the entry process. First, hemagglutinin mediates attachment of the virus to the surface of target cells through interactions with sialic acid receptors. Second, after endocytosis of the virus, hemagglutinin subsequently triggers the fusion of the viral and endosomal membranes to release its genome into the cytoplasm of the target cell. HA comprises a large ectodomain of ~500 amino acids that is cleaved by host-derived enzymes to generate 2 polypeptides that remain linked by a disulfide bond. The majority of the N-terminal fragment (HA1, 320-330 amino acids) forms a membrane-distal globular domain that contains the receptor-binding site and most determinants recognized by virus-neutralizing antibodies. The smaller C-terminal portion (HA2, ~180 amino acids) forms a stem-like structure that anchors the globular domain to the cellular or viral membrane. The degree of sequence homology between subtypes is smaller in the HA1 polypeptides (34%-59% homology between subtypes) than in the HA2 polypeptide (51%-80% homology). The most conserved region is the sequence around the cleavage site, particularly the HA2 N-terminal 23 amino acids, which is conserved among all influenza A virus subtypes (Lorieau et al., 2010). Part of this region is exposed as a surface loop in the HA precursor molecule (HA0), but becomes inaccessible when HA0 is cleaved into HA1 and HA2.

Most neutralizing antibodies bind to the loops that surround the receptor binding site and interfere with receptor binding and attachment. Since these loops are highly variable, most antibodies targeting these regions are strain-specific, explaining why current vaccines elicit such limited, strain-specific immunity. Recently, however, fully human monoclonal antibodies against influenza virus hemagglutinin with broad cross-neutralizing potency were generated. Functional and structural analysis have revealed that these antibodies interfere with the membrane fusion process and are directed against highly conserved epitopes in the stem domain of the influenza HA protein (Throsby et al., 2008; Ekiert et al. 2009, WO 2008/028946, WO2010/130636, WO 2013/007770).

Stem domain polypeptides stably presenting the epitopes of these antibodies are described in the co-pending patent application PCT/EP2012/073706. At least some of the stem domain polypeptides described herein stably present the epitope of CR6261 and/or CR9114 and are immunogenic in mice. Further immunogenic stem domain polypeptides stably presenting the epitope of CR6261 and/or CR9114 have been described in co-pending patent application PCT/EP2014/060997.

According to the present invention new multimeric HA stem domain polypeptides have been designed presenting these epitopes. These polypeptides can be used to create a universal epitope-based vaccine inducing protection against a broad range of influenza strains. Like in the previously described stem domain polypeptides, the highly variable and immunodominant part, i.e. the head domain, is first removed from the full length HA molecule to create a stem domain polypeptide, also called mini-HA, in order to redirect the immune response towards the stem domain where the epitopes for the broadly neutralizing antibodies are located. The broadly neutralizing antibodies mentioned above were used to confirm the presence of the neutralizing epitopes.

In certain embodiments, the new HA stem polypeptides of the present invention form stable trimers in solution while exposing the epitopes of the neutralizing antibodies CR6261 and/or CR9114 and/or CR8020. The additional interactions between individual monomers further stabilize the protein and the epitopes, leading to better presentation of these epitopes when the polypeptides are used in vaccine.

The stem domain polypeptides of this invention are capable of presenting the conserved epitopes of the membrane proximal stem domain HA molecule to the immune system in the absence of dominant epitopes that are present in the membrane distal head domain. To this end, part of the primary sequence of the HA0 protein making up the head domain is removed and reconnected, either directly or, in some embodiments, by introducing a short flexible linking sequence ('linker') to restore the continuity of the polypeptide chain. The resulting polypeptide sequence is further modified by introducing specific mutations that stabilize the native 3-dimensional structure of the remaining part of the HA0 molecule.

The present invention provides novel multimeric influenza hemagglutinin stem domain polypeptides, wherein said multimeric polypeptides comprise at least a first and a second influenza hemagglutinin stem domain monomer, said first and second monomer each comprising: (a) an influenza hemagglutinin HA1 domain that comprises an HA1 N-terminal stem segment, covalently linked by a linking sequence of 0-50 amino acid residues to an HA1 C-terminal stem segment, wherein said HA1 C-terminal segment is linked to (b) an influenza hemagglutinin HA2 domain, wherein said HA1 N-terminal segment comprises the amino acids 1-x of HA1, preferably the amino acids p-x of HA1, and wherein the HA1 C-terminal stem segment comprises the amino acids y-C-terminal amino acid of HA1, and (c) wherein the polypeptide comprises no protease cleavage site at the junction between the HA1 and HA2 domains; and
(d) wherein the first monomer is linked to said second monomer by a disulfide bridge between the amino acid on position 411 of the first monomer and the amino acid on position 419 of the second monomer.

According to the invention, the disulfide bridge thus forms a covalent cross-link between individual monomers in a multimer.

In certain embodiments, the multimeric polypeptide is trimeric, i.e. comprises three influenza stem domain monomers. According to the invention, each monomer is linked to another monomer by the disulfide bridge between the amino acid on position 411 of one monomer to the amino acid on position 419 of another monomer.

According to the present invention, it has surprisingly been found that the introduction of a novel disulfide bridge between the amino acid positions 411 and 419 (numbering according to SEQ ID NO: 1 or equivalent residues in hemagglutinin of other influenza viruses) of at least two different monomers results in a dimeric or, preferably, a trimeric polypeptide. In contrast to other published trimeric HA-stem structures this intermonomer disulfide linked trimer expresses well and folds spontaneously. It therefore does not require refolding procedures to reach its three-dimensional structure as has been described (Lu et al 2013).

In certain embodiments, the HA1 and HA2 domains are derived from an influenza A virus subtype derived from phylogenetic group 1.

In certain embodiments, the HA1 and HA2 domains are derived from an influenza A virus subtype comprising HA of the H1 subtype. The polypeptides of the invention do not comprise the full length HA1.

In certain embodiments, the HA1 and HA2 domains are derived from an influenza A virus subtype derived from phylogenetic group 2.

In certain embodiments, the HA1 and HA2 domains are derived from an influenza A virus subtype comprising HA of the H3 subtype.

In certain embodiments, the influenza hemagglutinin stem domain monomers are substantially smaller than HA0, preferably lacking all or substantially all of the globular head of HA. Preferably, the immunogenic polypeptides are no more than 360, preferably no more than 350, 340, 330, 320, 310, 305, 300, 295, 290, 285, 280, 275, or 270 amino acids in length. In certain embodiments, the immunogenic polypeptides are from about 250 to about 350, preferably from about 260 to about 340, preferably from about 270 to about 330 amino acids in length.

According to the invention, the "HA1 N-terminal segment" refers to a polypeptide segment that corresponds to the amino-terminal portion of the HA1 domain of an influenza hemagglutinin (HA) molecule. In certain embodiments, the HA1 N-terminal polypeptide segment comprises the amino acids from position 1 to position x of the HA1 domain, wherein amino acid on position x is an amino acid residue within HA1. The term "HA1 C-terminal segment" refers to a polypeptide segment that corresponds to the carboxy-terminal portion of an influenza hemagglutinin HA1 domain. In certain embodiments, the HA1 C-terminal polypeptide segment comprises the amino acids from position y to and including the C-terminal amino acid of the HA1 domain, wherein the amino acid on position y is an amino acid residue within HA1. According to the invention y is greater than x, thus a segment of the HA1 domain between the HA1 N-terminal segment and the HA1 C-terminal segment, i.e. between the amino acid on position x and the amino acid on position y of HA1, has been deleted, and in some embodiments, replaced by a linking sequence.

In certain embodiments the HA1 N-terminal stem segment comprises the amino acids 1-x of HA1, and the HA1 C-terminal stem segment comprises the amino acids y-end of HA1. Thus, in certain embodiments, the deletion in the HA1 segment comprises the amino acid sequence from the amino acid at position x+1 up to and including the amino acid at position y−1.

In certain embodiments, the polypeptides do not comprise the signal sequence. Thus in certain embodiments, the HA1 N-terminal segment comprises the amino acid p-x of HA1, wherein p is the first amino acid of the mature HA molecule (e.g. p=18 in case of SEQ ID NO: 1). The skilled person will be able to prepare the polypeptides described herein without the signal peptides (e.g. amino acids 1-17 of SEQ ID NO: 1).

It is again noted that the numbering of amino acid positions used herein refers to SEQ ID NO: 1. The skilled person will be able to determine the equivalent positions in other hemagglutinin sequences.

In certain embodiments, the polypeptides comprise the complete HA2 domain, thus including the transmembrane and intracellular sequences. In other embodiments, the polypeptides of the invention do not comprise the intracellular sequences of HA and the transmembrane domain. Thus, in certain embodiments the polypeptides comprise a truncated HA2 domain. In certain embodiments, the intracellular and transmembrane sequence, e.g. the amino acid sequence from position (or the equivalent of) 514, 515, 516, 517, 518, 519, 520, 521, 522, 523, 524, 525, 526, 527, 526, 528, 529, or 530 of the HA2 domain to the C-terminus of the HA2 domain has been removed, to produce a soluble polypeptide following expression in a cell.

According to the invention, the hemagglutinin stem domain polypeptides are resistant to protease cleavage at the junction between the HA1 and HA2 domain, i.e. do not comprise a protease cleavage site at this junction between HA1 and HA2. It is known to those of skill in the art that the Arg (R)-Gly (G) sequence spanning HA1 and HA2 is a recognition site for trypsin and trypsin-like proteases and is typically cleaved for hemagglutinin activation. Since the HA stem domain polypeptides described herein should not be activated, the influenza hemagglutinin stem domain polypeptides of the invention are resistant to protease cleavage. According to the invention, thus the protease cleavage site is removed or the protease site spanning HA1 and HA2 is mutated to a sequence that is resistant to protease cleavage. According to the invention, removal of the cleavage site between HA1 and HA2 can be achieved by mutation of R (in a small number of cases K) to Q at the P1 position (see e.g. Sun et al, 2010 for an explanation of the nomenclature of the cleavage site (position 343 in SEQ ID NO: 1). In certain embodiments, the C-terminal amino acid residue of the HA1 C-terminal stem segment is any amino acid other than arginine (R) or lysine (K). In certain embodiments, the HA1 C-terminal amino acid is glutamine (Q), serine (S), threonine (T), asparagine (N), aspartic acid (D) or glutamic acid (E). In certain embodiments, the C-terminal amino acid residue of the HA1 C-terminal stem segment is glutamine (Q).

In certain embodiments, the polypeptides are glycosylated.

In certain embodiments, the influenza hemagglutinin stem domain polypeptides are based on HA of influenza viruses of the H1 subtype. With "based on" it is meant that the N-terminal segments, and/or C-terminal segments of the HA1 domain and/or the HA2 domains have at least 70%, 75%, 80%, 85%, 90%, 95%, 96%, 97%, 98%, or 99% amino acid sequence identity with the corresponding N-terminal and/or C-terminal segments of HA1 and/or the HA2 domains of any naturally occurring influenza hemagglutinin of a H1 subtype known to those of skill in the art or later discovered.

In certain embodiments, the polypeptides are based on H1 HA, i.e. HA comprising an amino acid sequence from an influenza virus of the H1 subtype, in particular from the influenza virus A/Brisbane/59/2007 (H1N1) (SEQ ID NO:1), as described below. It will be understood by the skilled person that also other influenza A viruses comprising HA of the H1 subtype may be used according to the invention. In certain embodiments, the polypeptides comprise hemagglutinin stem domains based on HA of an influenza A H1 virus selected from Table 2.

In certain embodiments, the polypeptides comprise a HA1 N-terminal polypeptide segment comprising the amino acids from position 1 to position x of an H1 HA1 domain, wherein x is any amino acid between the amino acid on position 46 and the amino acid on position 60, such as the amino acid on position 47, 48, 49, 50, 51, 52, 53, 54, 55, 56, 57, 58, or 59, preferably wherein x is 52, 53, 55 or 59. Preferably, the polypeptides comprise a HA1 N-terminal segment without the signal sequence, i.e. a HA1 N-terminal segment comprising the amino acids from position 18 (e.g. for H1 HA, such as SEQ ID NO: 1), or an equivalent position in other influenza virus strains (see e.g. Table 2), to position x of the HA1 domain. In certain embodiments, the HA1 N-terminal segment thus comprises the amino acids from position p (wherein p=18 for H1 HA in SEQ ID NO: 1 or an equivalent position on other H1 HAs), to position x of the HA1 domain.

In certain embodiments, the HA1 C-terminal polypeptide segment comprises the amino acids from position y to and including the C-terminal amino acid of an H1 HA1 domain, wherein y is any amino acid between the amino acid on positions 290 and the amino acid on position 325 of H1 HA1, preferably wherein y is 291, 303, 318, or 321.

In certain embodiments, x=the amino acid on position 52 of SEQ ID NO: 1 (or an equivalent position in another hemagglutinin), p=the amino acid on position 18 of SEQ ID NO: 1 (or an equivalent position in another hemagglutinin) and y=the amino acid on position 321 of SEQ ID NO: 1 (or an equivalent position in another hemagglutinin). In certain embodiments, the HA1 N-terminal stem segment thus comprises the amino acids 1-52 of HA1, and the HA1 C-terminal stem segment comprises the amino acids 321-end (i.e. the C-terminal amino acid of HA1) of HA1. Thus, in certain embodiments, the deletion in the HA1 segment comprises the amino acid sequence from the amino acid at position 53 up to and including the amino acid at position 320. In certain embodiments, the polypeptides do not comprise the signal sequence. In certain embodiments, the HA1 N-terminal segment thus comprises the amino acid 18-52 of HA1, wherein p is the first amino acid of the mature HA molecule (e.g. p=18 in case of SEQ ID NO: 1).

In certain embodiments, the HA1 N-terminal stem segment thus comprises the amino acid residues 1-52 of HA1, preferably the amino acid residues 18-52 of HA1, and the HA1 C-terminal stem segment comprises the amino acid residues 321-343 of HA1. In certain embodiments, the HA1 N-terminal stem segment consists of the amino acid residues 1-52 of HA1, preferably the amino acid residues 18-52 of HA1, and the HA1 C-terminal stem segment consists of the amino acid residues 321-343 of HA1.

According to the invention, the stem polypeptides comprise one or more mutations, i.e. amino acid substitutions, in the HA1 domain and/or the HA2 domain of the individual monomers, as compared to the amino acid sequence of corresponding wild-type influenza virus HA1 and/or HA2 domains, i.e. the influenza virus on which the stem polypeptides are based.

Figure 1:
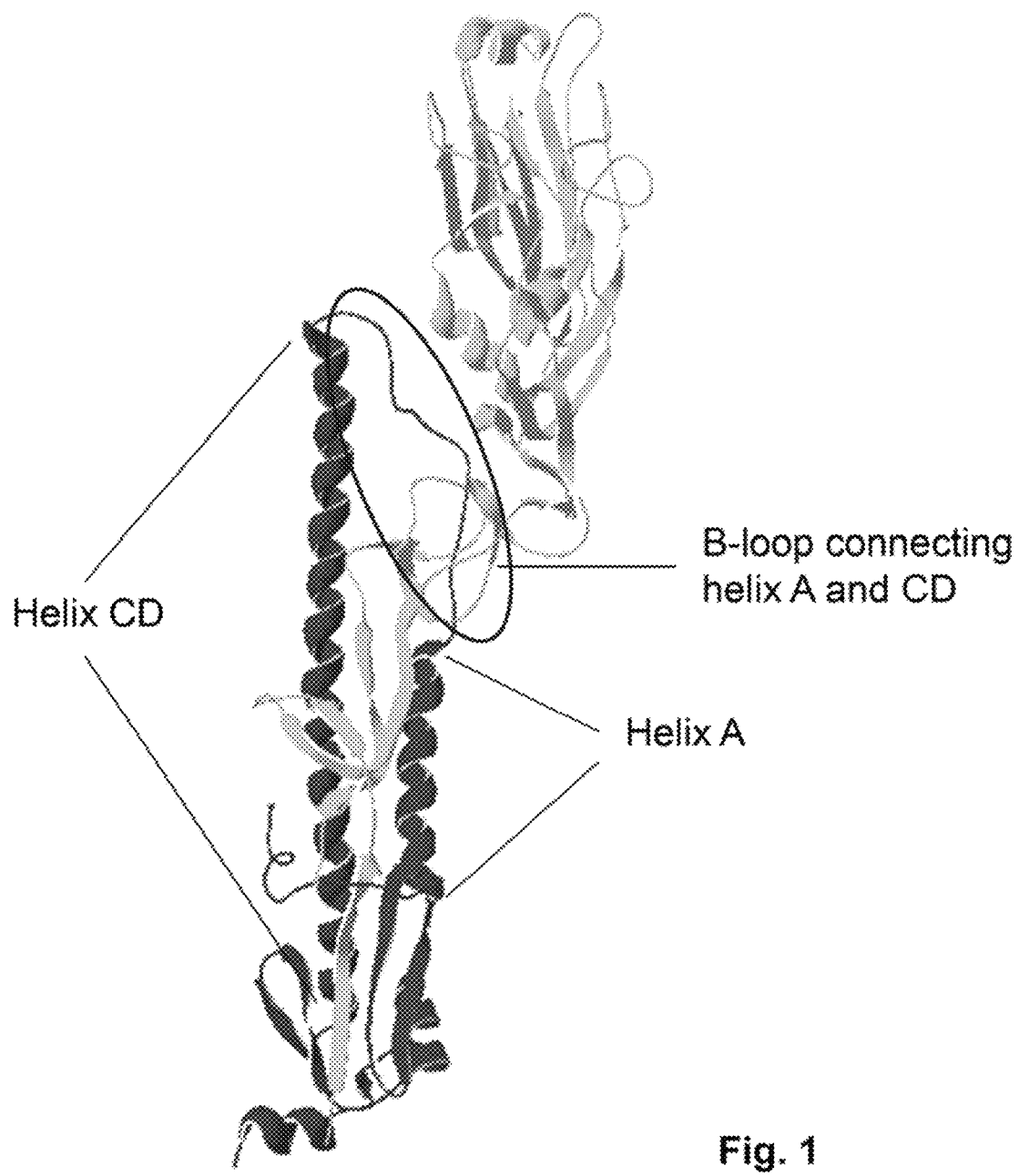
FIG. 1 shows a model of the HA monomer in the pre-fusion state as present in the native trimer. HA1 is shown in light grey, HA2 is shown in dark grey. Helix A (an important part of the epitope of CR6261) and helix CD (part of the trimer interface) are indicated, as is the loop connecting these secondary structure elements. The C-terminus of HA1 and the N-terminus of HA2 are also indicated. The fusion peptide is located at the N-terminus of HA2.

In certain embodiments, the HA2 domain comprises one or more mutations in the HA2 amino acid sequence connecting the C-terminal residue of helix A to the N-terminal residue of helix CD (FIG. 1). The H1 HA2 amino acid sequence connecting the C-terminal residue of helix A and the N-terminal residue of helix CD comprises the amino acid sequence comprising residues 402-418 of influenza HA (numbering according to SEQ ID NO: 1), comprising the amino acid sequence MNTQFTAVGKEFN(H/K)LE(K/R) (SEQ ID NO: 7).

In certain embodiments, the amino acid sequence connecting the C-terminal residue of helix A to the N-terminal residue of helix CD, i.e. the region comprising the amino acid residues 402-418 of influenza HA of serotype H1 (numbering according to SEQ ID NO: 1) comprises the amino acid sequence $X_1NTQX_2TAX_3GKEX_4N(H/K)X_5E$ (K/R) (SEQ ID NO: 8).

In certain embodiments, one or more of the amino acids on position 402, 406, 409, 413 and 416 (numbering refers to SEQ ID NO: 1), i.e one or more of the amino acids $X_1$, $X_2$, $X_3$, $X_4$ and $X_5$ have been mutated, i.e. comprise an amino acid that is not occurring at those positions in a wild-type influenza virus on which the stem polypeptide is based.

In certain embodiments, the mutated amino acid on position 402, i.e. $X_1$, is an amino acid selected from the group consisting of M, E, K, V, R and T.

In certain embodiments, the mutated amino acid on position 406, i.e. $X_2$, is an amino acid selected from the group consisting of F, I, N, T, H, L and Y, preferably I, L or Y.

In certain embodiments, the mutated amino acid on position 409, i.e. $X_3$, is an amino acid selected from the group consisting of V, A, G, I, R, F and S, preferably A, I or F.

In certain embodiments, the mutated amino acid on position 413, i.e. $X_4$, is an amino acid selected from the group consisting of F, I, N, S, T, Y, E, K, M, and V, preferably 1, Y, M or V.

In certain embodiments, the mutated amino acid on position 416, i.e. $X_5$, is an amino acid selected from the group consisting of L, H, I, N, R, preferably I.

Combinations of one or more of these mutations are also possible.

In certain embodiments, $X_1$ is M, $X_2$ is Y, $X_3$ is I, $X_4$ is Y and $X_5$ is S.

According to the invention, the stem polypeptides comprise one or more additional mutations, i.e. amino acid substitutions, in the HA1 domain and/or the HA2 domain, as compared to the amino acid sequence of corresponding wild-type influenza virus HA1 and/or HA2 domains, i.e. the influenza virus on which the stem polypeptides are based.

In certain embodiments, one or more amino acid residues close to the HA0 cleavage site (residue 343 in SEQ ID NO: 1) have been mutated. In certain embodiments, one or more of the amino acid residues on position 337, 340, 352, or 353 of SEQ ID NO: 1, or equivalent positions in other influenza viruses, have been mutated, i.e. are substituted by an amino acid that is not occurring at the corresponding position in the amino acid sequence of the HA of the wild-type influenza virus on which the stem polypeptide is based. Table 6 shows the the naturally occurring amino acid variation.

In certain embodiments, the polypeptides of the invention comprise at least one mutation on position 352 of SEQ ID NO: 1, or on an equivalent position of other influenza viruses.

In certain embodiments, the polypeptides of the invention comprise at least one mutation on position 353 of SEQ ID NO: 1, or on an equivalent position of other influenza viruses.

In certain embodiments, the polypeptides of the invention comprise at least one mutation on position 337 of SEQ ID NO: 1, or on an equivalent position of other influenza viruses.

In certain embodiments, the polypeptides of the invention comprise at least one mutation on position 340 of SEQ ID NO: 1, or on an equivalent position of other influenza viruses.

In certain embodiments, the mutated amino acid residue on position 337 (HA1 domain) is selected from the group consisting of I, E, K, V, A, and T.

In certain embodiments, the mutated amino acid residue on position 340 (HA1 domain) is selected from the group consisting of I, K, R, T, F, N, S and Y.

In certain embodiments, the mutated amino acid residue on position 352 (HA2 domain) is selected from the group consisting of D, V, Y, A, I, N, S, and T.

In certain embodiments, the mutated amino acid residue on position 353 (HA2 domain) is selected from the group consisting of K, R, T, E, G, and V.

In certain embodiments the mutated amino acid introduces a consensus N-glycoslation e.g. N-X-T/S (where X is any naturally occurring amino acid except P) in the sequence as is for example the case for 1340N in SEQ ID NO: 6.

In certain embodiments, the mutated amino acid is an amino acid that does not naturally occur in sequences of the same subtype.

In certain embodiments, the the mutated amino acid residue on position 337 (HA1 domain) is K.

In certain embodiments, the mutated amino acid residue on position 340 (HA1 domain) is K.

In certain embodiments, the mutated amino acid residue on position 352 (HA2 domain) is F.

In certain embodiments, the mutated amino acid residue on position 353 (HA2 domain) is T.

It is again noted that throughout this application the numbering of the amino acids is based on the numbering of amino acids in H1 HA0, in particular the numbering of the amino acids of the H1N1 influenza strain A/Brisbane/59/2007 (SEQ ID NO: 1). The skilled person will be able to determine the equivalent amino acids in HA of other influenza viruses and thus will be able to determine equivalent mutations, see e.g. Table 2 for the sequence alignment of different H1 influenza viruses.

According to the invention, the polypeptides further may comprise an additional disulfide bridge between the amino acid on position 324 and the amino acid on position 436. Thus, according to the invention at least one additional disulfide bridge has been introduced in the stem domain polypeptides, preferably between amino acids of (or the equivalent of) position 324 and 436 in H1 A/Brisbane/59/2007 (SEQ ID NO: 1). In certain embodiments, the polypeptides thus further comprise the mutation R324C in the HA1 domain and T436C in the HA2 domain. Equivalent positions can be easily determined by those skilled in the art by aligning the sequences using a suitable algorithm such as Clustal, Muscle etc. Engineered disulfide bridges are created by mutating at least one (if the other is already a cysteine), but usually two residues that are spatially close into cysteine, that will spontaneously or by active oxidation form a covalent bond between the sulfur atoms of these residues.

In certain embodiments, the influenza hemagglutinin stem domain polypeptides are based on HA of influenza viruses of the H3 subtype. With "based on" it is meant that the N-terminal segments, and/or C-terminal segments of the HA1 domain and/or the HA2 domains have at least 70%, 75%, 80%, 85%, 90%, 95%, 96%, 97%, 98%, or 99% amino acid sequence identity with the corresponding N-terminal and/or C-terminal segments of HA1 and/or the HA2 domains of any naturally occurring influenza hemagglutinin of a H3 subtype known to those of skill in the art or later discovered. In certain embodiments, the polypeptides are based on H3 HA, i.e. HA comprising an amino acid sequence from an influenza virus of the H3N2 virus A/Hong Kong/1/1968 (SEQ ID NO: 237), as described below. It will be understood by the skilled person that also other influenza A viruses comprising HA of the H3 subtype may be used according to the invention.

In certain embodiments, the amino acid sequence CMKQ-IEDKIEEIESK (SEQ ID NO: 193) has been introduced at positions 419-433 of SEQ ID NO: 1 (or equivalent positions in different HAs) or the amino acid sequence RMCQIED- KIEEIESKQK (SEQ ID NO: 194) has been introduced at position 417-433 of SEQ ID NO: 1 (or equivalent positions in different HAs).

In certain embodiments, the polypeptides further comprise one or more additional mutations in the HA1 and/or HA2 domain, as compared to the amino acid sequence of the HA of which the HA1 and HA2 domains are derived. Thus, the stability of the stem polypeptides is further increased.

In certain embodiments, the polypeptides selectively bind to the antibodies CR6261 and/or CR9114. In an embodiment, the polypeptide does not bind to the antibodies CR8020 and/or CR8057. In an embodiment, CR6261 comprises a heavy chain variable region comprising the amino acid sequence of SEQ ID NO: 9 and a light chain variable region comprising the amino acid sequence of SEQ ID NO: 10; CR9114 comprises a heavy chain variable region comprising the amino acid sequence of SEQ ID NO: 11 and a light chain variable region comprising the amino acid sequence of SEQ ID NO: 12. In an embodiment, CR8057 comprises a heavy chain variable region comprising the amino acid sequence of SEQ ID NO: 13 and a light chain variable region comprising the amino acid sequence of SEQ ID NO: 14. CR8020 comprises a heavy chain variable region comprising the amino acid sequence of SEQ ID NO: 17 and a light chain variable region comprising the amino acid sequence of SEQ ID NO: 18.

In certain embodiments, the polypeptides do selectively bind to the antibody CR8020.

According to the present invention, in certain embodiments multimeric polypeptides thus are provided that mimic the specific epitopes of CR6261, CR9114, and/or CR8020, and that can be used as immunogenic polypeptides, e.g. to elicit cross-neutralizing antibodies when administered in vivo, either alone, or in combination with other prophylactic and/or therapeutic treatments. With "cross-neutralizing antibodies", antibodies are meant that are capable of neutralizing at least two, preferably at least three, four, or five different subtypes of influenza A viruses of phylogenetic group 1, and/or at least two, preferably at least three, four, or five different subtypes of influenza A viruses of phylogenetic group 2, and/or at least two, different subtypes of influenza B viruses, in particular at least all virus strains that are neutralized by CR6261 and CR9114.

As described above, the polypeptides comprise at least two monomers, wherein said monomers each comprise an influenza hemagglutinin HA1 domain that comprises an HA1 N-terminal stem segment that is covalently linked by a linking sequence of 0-50 amino acid residues to the HA1 C-terminal stem segment. The linking sequence does not occur in naturally occurring, or wild-type, HA. In certain embodiments, the linker is a peptide that comprises one amino acid residue, two or less amino acid residues, three or less amino acid residues, four or less amino acid residues, five or less amino acid residues, ten or less amino acid residues, 15 or less amino acid residues, or 20 or less amino acid residues or 30 or less amino acid residues or 40 or less amino acid residues or 50 or less amino acid residues. In a specific embodiment, the linking sequence is a sequence selected from the group consisting of G, GS, GGG, GSG, GSA, GSGS, GSAG, GGGG, GSAGS, GSGSG, GSAGSA, GSAGSAG, and GSGSGSG.

In certain embodiments, the HA1 N-terminal segment is directly linked to the HA1 C-terminal segment, i.e. the polypeptides do not comprise a linking sequence.

Influenza HA in its native form exists as a trimer on the cell or virus membrane. In certain embodiments the intracellular and transmembrane sequence is removed so that a secreted (soluble) polypeptide is produced following expression in cells. Methods to express and purify secreted ectodomains of HA have been described (see e.g. Dopheide et al 2009; Ekiert et al 2009, 2011; Stevens et al 2004, 2006; Wilson et al 1981). A person skilled in the art will understand that these methods can also be applied directly to stem domain polypeptides of the invention in order to achieve expression of secreted (soluble) polypeptide. Therefore these polypeptides are also encompassed in the invention.

In certain embodiments, the polypeptides of the invention contain the intracellular sequences of HA and the transmembrane domain. In other embodiments, the intracellular and transmembrane sequences, e.g. the amino acid sequence from position (or the equivalent of) 514, 515, 516, 517, 518, 519, 520, 521, 522, 523, 524, 525, 526, 527, 526, 528, 529, or 530 of the HA2 domain to the C-terminus of the HA2 domain (numbering according to SEQ ID NO: 1) have been removed to produce a soluble polypeptide following expression in cells.

In certain embodiments, the C-terminal part of the HA2 domain from position 519 to the C-terminal amino acid has been deleted. In further embodiments, the C-terminal part of the HA2 domain from position 530 to the C-terminal amino acid has been deleted.

Optionally, a his-tag sequence (HHHHHH (SEQ ID NO: 15) or HHHHHHH (SEQ ID NO: 16)) may be linked to the (optionally truncated) HA2 domain, for purification purposes, optionally connected through a linker. Optionally the linker may contain a proteolytic cleavage site to enzymatically remove the his-tag after purification.

In certain embodiments, the polypeptides are further stabilized by introducing a sequence known to form trimeric structures, i.e. GYIPEAPRDGQAYVRKDGEWVLLSTFL (SEQ ID NO: 3) at the C-terminus of HA2, optionally connected through a linker. Thus, in certain embodiments, the C-terminal part of the HA2 domain has been replaced by the amino acid sequence GYIPEAPRDGQAY-VRKDGEWVLLSTFL (SEQ ID NO: 3), optionally connected through a linker. The linker may optionally contain a cleavage site for processing afterwards according to protocols well known to those skilled in the art. To facilitate purification of the soluble form a tag sequence may be added, e.g. a his tag (HHHHHH (SEQ ID NO: 15) or HHHHHHH (SEQ ID NO: 16)) or FLAG tag (DYKDDDDK) (SEQ ID NO: 22) or a combination of these, optionally connected via short linkers. The linker may optionally contain (part of) a proteolytic cleavage site, e.g. IEGR (SEQ ID NO: 24) (Factor X) or LVPRGS (SEQ ID NO: 23) (thrombin) for processing afterwards according to protocols well known to those skilled in the art. The processed proteins are also encompassed in the invention.

In certain embodiments, the C-terminal part of the HA2 domain from position 519-565 has been deleted (numbering according to SEQ ID NO: 1) and replaced by SGRDYKDDDDKLVPRGSPGSGYIPEAPRDGQAY-VRKDGEWVLLSTFLGHHHHH H (SEQ ID NO: 4).

In certain embodiments, the C-terminal part of the HA2 domain from position 530-565 has been deleted (numbering according to SEQ ID NO: 1) and replaced by SGRDYKDDDDKLVPRGSPGSGYIPEAPRDGQAY-VRKDGEWVLLSTFLGHHHHH H (SEQ ID NO: 4).

The native HA exists as a trimer on the cell surface. Most of the interactions between the individual monomers that keep the trimer together are located in the head domain while in the stem domain trimerization is mediated by the formation of a trimeric coiled coil motif. After removal of the head the tertiary structure is destabilized and therefore modifications are needed in order to increase protein stability. By strengthening the helical propensity of the helix CD a more stable protein can be created.

In the polypeptides described in the co-pending application PCT/EP2014/060997, the sequence MKQIEDKIEE-IESKQ (SEQ ID NO: 5), derived from yeast transcriptional activator protein GCN4 and known to trimerize was introduced in the CD helix at (the equivalent of) position 419-433. This sequence has a high propensity to form helical secondary structures and can enhance in this way overall stability of the polypeptides of the invention.

It was further shown that the stability and multimerizarion state of the polypeptide is dependent on the exact location and sequence of the GCN4 derived sequence in the primary sequence of the polypeptides of the invention.

In preferred embodiments, the amino acid sequence CMKQIEDKIEEIESK (SEQ ID NO: 193) has been introduced at positions 419-433 or wherein sequence RMCQIEDKIEEIESKQK (SEQ ID NO: 194) has been introduced at position 417-433.

In the research that led to the present invention, polypeptides s74H9 (SEQ ID NO: 65), s127H1 (SEQ ID NO: 66), s71H2 (SEQ ID NO: 71), s86B4 (SEQ ID NO: 67), s115A1 (SEQ ID NO: 70), s2201C9 (SEQ ID NO: 77), s55G7 (SEQ ID NO: 68), s113E7 (SEQ ID NO: 78), s6E12 (SEQ ID NO: 69), s181H9 (SEQ ID NO: 76) were modified, using techniques of molecular biology well known to those skilled in the art, to create sequences s74H9-t2 (SEQ ID NO: 93), s1271H1-t2 (SEQ ID NO: 91), s71H2-t2 (SEQ ID NO: 97), s86B4-t2 (SEQ ID NO: 92), s115A1-t2 (SEQ ID NO: 96), s220C9-t2 (SEQ ID NO: 99), s55G7-t2 (SEQ ID NO: 95), s113E7-t2 (SEQ ID NO: 100), s6E12-t2 (SEQ ID NO: 94), s181H9-t2 (SEQ ID NO: 98) containing sequence RMKQIEDKIEEIESK (SEQ ID NO: 20) at position 419-433.

In a similar manner, polypeptides s74H9-t3 (SEQ ID NO: 123), s127H1-t3 (SEQ ID NO: 121), s71H2-t3 (SEQ ID NO: 127), s86B4-t3 (SEQ ID NO: 122), s115A1-t3 (SEQ ID NO: 126), s2201C9-t3 (SEQ ID NO: 129), s55G7-t3 (SEQ ID NO: 125), s113E7-t3 (SEQ ID NO: 130), s6E12-t3 (SEQ ID NO: 124), s181H9-t3 (SEQ ID NO: 128) containing sequence RMKQIEDKIEEIESKQK (SEQ ID NO: 21) at position 417-433 were created.

According to the invention, a disulfide bridge between the amino acid on position 411 of a first monomer and the amino acid on position 419 of a second monomer has been introduced by mutating the amino acids on positions 411 and 419 to a cysteine. Thus, in certain embodiments, the amino acid sequence CMKQIEDKIEEIESK (SEQ ID NO: 193) has been introduced at positions 419-433 or the amino acid sequence RMCQIEDKIEEIESKQK (SEQ ID NO: 194) has been introduced at position 417-433.

As described above, applicants have previously identified broadly neutralizing antibodies isolated from primary human B-cells from vaccinated individuals some of which were specific for group 1 (e.g. CR6261, as described in WO 2008/028946) and some of which were specific for group 2 influenza viruses (e.g. CR8020 as described in WO 2010/130636). Detailed analysis of the epitopes of these monoclonal antibodies has revealed the reason for the lack of cross-reactivity of these specific antibodies. In both cases the presence of glycans in group 1 or group 2 HA molecules on different positions at least partly explained the fact that the antibodies are group-specific. With the identification of CR9114-like antibodies that cross-react with many group 1 and 2 HA molecules, as described below, it has become clear that it is possible for the human immune system to elicit very broad neutralizing antibodies against influenza viruses. However, given the need for a yearly vaccination scheme these antibodies are apparently not, or only to a very low extent elicited following infection or vaccination with (seasonal) influenza viruses of subtypes H1 and/or H3.

According to the present invention multimeric polypeptides are provided that mimic the specific epitopes of CR6261 and/or CR9114, and/or CR8020, and that can be used as immunogenic polypeptides, e.g. to elicit cross-neutralizing antibodies when administered in vivo, either alone, or in combination with other prophylactic and/or therapeutic treatments. With "cross-neutralizing antibodies", antibodies are meant that are capable of neutralizing at least two, preferably at least three, four, or five different subtypes of influenza A viruses of phylogenetic group 1, and/or at least two, preferably at least three, four, or five different subtypes of influenza A viruses of phylogenetic group 2, and/or at least two, different subtypes of influenza B viruses, in particular at least all virus strains that are neutralized by CR6261 and/or CR9114, and/or CR8020.

In certain embodiments, the polypeptides selectively bind to the antibodies CR6261 and/or CR9114. In certain embodiments, the polypeptide does not bind to the antibody CR8057. CR6261 comprises a heavy chain variable region comprising the amino acid sequence of SEQ ID NO: 9 and a light chain variable region comprising the amino acid sequence of SEQ ID NO: 10; CR9114 comprises a heavy chain variable region comprising the amino acid sequence of SEQ ID NO: 11 and a light chain variable region comprising the amino acid sequence of SEQ ID NO: 12; CR8020 comprises a heavy chain variable region comprising the amino acid sequence of SEQ ID NO: 17 and a light chain variable region comprising the amino acid sequence of SEQ ID NO: 18. CR8057 comprises a heavy chain variable region comprising the amino acid sequence of SEQ ID NO: 13 and a light chain variable region comprising the amino acid sequence of SEQ ID NO: 14.

In certain embodiments, the polypeptides of the present invention are trimeric.

In certain embodiments, the polypeptide monomers comprise the amino acid sequence:

(SEQ ID NO: 145)
DTICIGYHANNSTDTVDTVLEKNVTVTHSVNLLENGGGGKYVCSAKLRMV

TGLRNX$_1$PSX$_2$QSQGLFGAIAGX$_3$X$_4$EGGWTGMVDGWYGYHHQNEQGSGYA

ADQKSTQNAINGITNKVNSVIEKX$_5$NTQX$_6$TAX$_7$GCEX$_8$NKX$_9$ERCMKQIE

DKIEEIESKIWCYNAELLVLLENERTLDFHDSNVKNLYEKVKSQLKNNAK

EIGNGCFEFYHKCNDECMESVKNGTYDYPKYSEESKLNREKIDGVSGRDY

KDDDDKLVPRGSPGSGYIPEAPRDGQAYVRKDGEWVLLSTFLGHHHHHH, wherein X$_1$ is an amino acid selected from the group consisting of E, I, K, V, A, and T;

X$_2$ is an amino acid selected from the group consisting of I, K, R, T, F, N, S and Y;

X$_3$ is an amino acid selected from the group consisting of D, F, V, Y, A, I, N, S, and T;

X$_4$ is an amino acid selected from the group consisting of I, K, R, T, E, G and V;

X$_5$ is an amino acid selected from the group consisting of M, E, K, V, R, T;

X$_6$ is an amino acid selected from the group consisting of F, I, N, S, T, Y, H, and L;

X$_7$ is an amino acid selected from the group consisting of A, G, I, R, T, V, F, and S;

$X_8$ is an amino acid selected from the group consisting of F, I, N, S, T, Y, G, E, K, M, and V; and $X_9$ is an amino acid selected from the group consisting of H, I, L, N, R, and S.

In certain embodiments, the polypeptide monomers comprise the amino acid sequence:

(SEQ ID NO: 146)
DTICIGYHANNSTDTVDTVLEKNVTVTHSVNLLENGGGGKYVCSAKLRMV

TGLRNX$_1$PSX$_2$QSQGLFGAIAGX$_3$X$_4$EGGWTGMVDGWYGYHHQNEQGSGYA

ADQKSTQNAINGITNKVNSVIEKX$_5$NTQX$_6$TAX$_7$GCEX$_8$NKX$_9$ERCMKQIED

KIEEIESKIWCYNAELLVLLENERTLDFHDSNVKNLYEKVKSQLKNNAKE

IGNGCFEFYHKCNDECMESVKNGTYDYPKYSEESKLNREKIDG, wherein $X_1$ is an amino acid selected from the group consisting of E, I, K, V, A, and T;

$X_2$ is an amino acid selected from the group consisting of I, K, R, T, F, N, S and Y;

$X_3$ is an amino acid selected from the group consisting of D, F, V, Y, A, I, N, S, and T;

$X_4$ is an amino acid selected from the group consisting of I, K, R, T, E, G and V;

$X_5$ is an amino acid selected from the group consisting of M, E, K, V, R, T;

$X_6$ is an amino acid selected from the group consisting of F, I, N, S, T, Y, H, and L;

$X_7$ is an amino acid selected from the group consisting of A, G, I, R, T, V, F, and S;

$X_8$ is an amino acid selected from the group consisting of, I, N, S, T, Y, G, E, K, M, and V; and $X_9$ is an amino acid selected from the group consisting of H, I, L, N, R, and S.

In certain embodiments, the polypeptide monomers comprise the amino acid sequence:

(SEQ ID NO: 147)
DTICIGYHANNSTDTVDTVLEKNVTVTHSVNLLENGGGGKYVCSAKLRMV

TGLRNX$_1$PSX$_2$QSQGLFGAIAGX$_3$X$_4$EGGWTGMVDGWYGYHHQNEQGSGYA

ADQKSTQNAINGITNKVNSVIEKX$_5$NTQX$_6$TAX$_7$GCEX$_8$NKX$_9$ERCMKQIED

KIEEIESKIWCYNAELLVLLENERTLDFHDSNVKNLYEKVKSQLKNNAKEI

GNGCFEFYHKCNDECMESVKNGTYDYPKYSEESKLNREKIDGVKLESMGVY

QIEG, wherein $X_1$ is an amino acid selected from the group consisting of E, I, K, V, A, and T;

$X_2$ is an amino acid selected from the group consisting of I, K, R, T, F, N, S and Y;

$X_3$ is an amino acid selected from the group consisting of D, F, V, Y, A, I, N, S, and T;

$X_4$ is an amino acid selected from the group consisting of I, K, R, T, E, G and V;

$X_5$ is an amino acid selected from the group consisting of M, E, K, V, R, T;

$X_6$ is an amino acid selected from the group consisting of F, I, N, S, T, Y, H, and L;

$X_7$ is an amino acid selected from the group consisting of A, G, I, R, T, V, F, and S;

$X_8$ is an amino acid selected from the group consisting of F, I, N, S, T, Y, G, E, K, M and V; and $X_9$ is an amino acid selected from the group consisting of H, I, L, N, R, and S.

In certain embodiments, the polypeptide monomers comprise the amino acid sequence:

(SEQ ID NO: 148)
DTICIGYHANNSTDTVDTVLEKNVTVTHSVNLLENGGGGKYVCSAKLRMV

TGLRNX$_1$PSX$_2$QSQGLFGAIAGX$_3$X$_4$EGGWTGMVDGWYGYHHQNEQGSGYA

ADQKSTQNAINGITNKVNSVIEKX$_5$NTQX$_6$TAX$_7$GCEX$_8$NKX$_9$ERCMKQIED

KIEEIESKIWCYNAELLVLLENERTLDFHDSNVKNLYEKVKSQLKNNAEE

IGNGCFEFYHKCNDECMESVKNGTYDYPKYSEESKLNREKIDGVKLESMG

VYQILAIYSTVASSLVLLVSLGAISFWMCSNGSLQCRICI, wherein $X_1$ is an amino acid selected from the group consisting of E, I, K, V, A, and T;

$X_2$ is an amino acid selected from the group consisting of I, K, R, T, F, N, S and Y;

$X_3$ is an amino acid selected from the group consisting of D, F, V, Y, A, I, N, S, and T;

$X_4$ is an amino acid selected from the group consisting of D, K, R, T, E, G and V;

$X_5$ is an amino acid selected from the group consisting of M, E, K, V, R, T;

$X_6$ is an amino acid selected from the group consisting of F, I, N, S, T, Y, H, and L;

$X_7$ is an amino acid selected from the group consisting of A, G, I, R, T, V, F, and S;

$X_8$ is an amino acid selected from the group consisting of F, I, N, S, T, Y, G, E, K, M and V; and $X_9$ is an amino acid selected from the group consisting of H, I, L, N, R, and S.

In certain embodiments, $X_1$ is K, $X_2$ is K, $X_3$ is F, $X_4$ is T, $X_5$ is M, $X_6$ is Y, $X_7$ is I; $X_8$ is Y and $X_9$ is S.

The influenza hemagglutinin stem domain polypeptides can be prepared according to any technique deemed suitable to one of skill, including techniques described below.

Thus, the immunogenic polypeptides of the invention may be synthesized as DNA sequences by standard methods known in the art and cloned and subsequently expressed, in vitro or in vivo, using suitable restriction enzymes and methods known in the art. The present invention thus also relates to nucleic acid molecules encoding the above described polypeptides. The invention further relates to vectors comprising the nucleic acids encoding the polypeptides of the invention. In certain embodiments, a nucleic acid molecule according to the invention is part of a vector, e.g. a plasmid. Such vectors can easily be manipulated by methods well known to the person skilled in the art, and can for instance be designed for being capable of replication in prokaryotic and/or eukaryotic cells. In addition, many vectors can directly or in the form of an isolated desired fragment there from be used for transformation of eukaryotic cells and will integrate in whole or in part into the genome of such cells, resulting in stable host cells comprising the desired nucleic acid in their genome. The vector used can be any vector that is suitable for cloning DNA and that can be used for transcription of a nucleic acid of interest. When host cells are used it is preferred that the vector is an integrating vector. Alternatively, the vector may be an episomally replicating vector.

The person skilled in the art is capable of choosing suitable expression vectors, and inserting the nucleic acid sequences of the invention in a functional manner. To obtain expression of nucleic acid sequences encoding polypeptides, it is well known to those skilled in the art that sequences capable of driving expression can be functionally linked to the nucleic acid sequences encoding the polypeptide, resulting in recombinant nucleic acid molecules encoding a protein or polypeptide in expressible format. In general, the promoter sequence is placed upstream of the sequences that should be expressed. Many expression vectors are available in the art, e.g. the pcDNA and pEF vector series of Invitrogen, pMSCV and pTK-Hyg from BD Sciences, pCMV-Script from Stratagene, etc, which can be used to obtain suitable promoters and/or transcription terminator sequences, polyA sequences, and the like. Where the sequence encoding the polypeptide of interest is properly inserted with reference to sequences governing the transcription and translation of the encoded polypeptide, the resulting expression cassette is useful to produce the polypeptide of interest, referred to as expression. Sequences driving expression may include promoters, enhancers and the like, and combinations thereof. These should be capable of functioning in the host cell, thereby driving expression of the nucleic acid sequences that are functionally linked to them. The person skilled in the art is aware that various promoters can be used to obtain expression of a gene in host cells. Promoters can be constitutive or regulated, and can be obtained from various sources, including viruses, prokaryotic, or eukaryotic sources, or artificially designed. Expression of nucleic acids of interest may be from the natural promoter or derivative thereof or from an entirely heterologous promoter (Kaufman, 2000). Some well-known and much used promoters for expression in eukaryotic cells comprise promoters derived from viruses, such as adenovirus, e.g. the E1A promoter, promoters derived from cytomegalovirus (CMV), such as the CMV immediate early (IE) promoter (referred to herein as the CMV promoter) (obtainable for instance from pcDNA, Invitrogen), promoters derived from Simian Virus 40 (SV40) (Das et al, 1985), and the like. Suitable promoters can also be derived from eukaryotic cells, such as methallothionein (MT) promoters, elongation factor 1α (EF-1α) promoter (Gill et al., 2001), ubiquitin C or UB6 promoter (Gill et al., 2001), actin promoter, an immunoglobulin promoter, heat shock promoters, and the like. Testing for promoter function and strength of a promoter is a matter of routine for a person skilled in the art, and in general may for instance encompass cloning a test gene such as lacZ, luciferase, GFP, etc. behind the promoter sequence, and test for expression of the test gene. Of course, promoters may be altered by deletion, addition, mutation of sequences therein, and tested for functionality, to find new, attenuated, or improved promoter sequences. According to the present invention, strong promoters that give high transcription levels in the eukaryotic cells of choice are preferred.

The constructs may be transfected into eukaryotic cells (e.g. plant, fungal, yeast or animal cells) or suitable prokaryotic expression systems like *E. coli* using methods that are well known to persons skilled in the art. In some cases a suitable 'tag' sequence (such as for example, but not limited to, a his-, myc-, strep-, or flag-tag) or complete protein (such as for example, but not limited to, maltose binding protein or glutathione S transferase) may be added to the sequences of the invention to allow for purification and/or identification of the polypeptides from the cells or supernatant. Optionally a sequence containing a specific proteolytic site can be included to afterwards remove the tag by proteolytic digestion.

Purified polypeptides can be analyzed by spectroscopic methods known in the art (e.g. circular dichroism spectroscopy, Fourier Transform Infrared spectroscopy and NMR spectroscopy or X-ray crystallography) to investigate the presence of desired structures like helices and beta sheets. ELISA, Octet and FACS and the like can be used to investigate binding of the polypeptides of the invention to the broadly neutralizing antibodies described before (CR6261, CR9114, CR8057). Thus, polypeptides according to the invention having the correct conformation can be selected.

The invention further relates to compositions comprising a therapeutically effective amount of at least one of the polypeptides and/or nucleic acids of the invention. The compositions preferably are immunogenic compositions. The compositions preferably further comprise a pharmaceutically acceptable carrier. In the present context, the term "pharmaceutically acceptable" means that the carrier, at the dosages and concentrations employed, will not cause unwanted or harmful effects in the subjects to which they are administered. Such pharmaceutically acceptable carriers and excipients are well known in the art (see Remington's Pharmaceutical Sciences, 18th edition, A. R. Gennaro, Ed., Mack Publishing Company [1990]; Pharmaceutical Formulation Development of Peptides and Proteins, S. Frokjaer and L. Hovgaard, Eds., Taylor & Francis [2000]; and Handbook of Pharmaceutical Excipients, 3rd edition, A. Kibbe, Ed., Pharmaceutical Press [2000]). The term "carrier" refers to a diluent, adjuvant, excipient, or vehicle with which the composition is administered. Saline solutions and aqueous dextrose and glycerol solutions can e.g. be employed as liquid carriers, particularly for injectable solutions. The exact formulation should suit the mode of administration. The polypeptides and/or nucleic acid molecules preferably are formulated and administered as a sterile solution. Sterile solutions are prepared by sterile filtration or by other methods known per se in the art. The solutions can then be lyophilized or filled into pharmaceutical dosage containers. The pH of the solution generally is in the range of pH 3.0 to 9.5, e.g. pH 5.0 to 7.5.

The invention also relates to influenza HA stem domain polypeptides, nucleic acid molecules and/or vectors as described above for use in inducing an immune response against influenza HA protein. The invention also relates to methods for inducing an immune response in a subject, the method comprising administering to a subject, a polypeptide, nucleic acid molecule and/or immunogenic composition as described above. A subject according to the invention preferably is a mammal that is capable of being infected with an infectious disease-causing agent, in particular an influenza virus, or otherwise can benefit from the induction of an immune response, such subject for instance being a rodent, e.g. a mouse, a ferret, or a domestic or farm animal, or a non-human-primate, or a human. Preferably, the subject is a human subject. The invention thus provides methods for inducing an immune response to an influenza virus hemagglutinin (HA), in particular of a group 1 and/or group 2 influenza A virus, such as an influenza virus comprising HA of the H1, H2, H3, H4, H5, H7 and/or H10 subtype, and/or of an influenza B virus, in a subject utilizing the polypeptides, nucleic acids and/or immunogenic compositions described herein. In some embodiments, the invention provides methods for inducing an immune response to an influenza virus comprising HA of the H1 subtype, in a subject utilizing the polypeptides, nucleic acids and/or immunogenic compositions described herein.

In some embodiments, the immune response induced is effective to prevent and/or treat an influenza virus infection caused by a group 1 and/or group 2 influenza A virus subtypes and/or influenza B viruses. In some embodiments, the immune response induced by the polypeptides, nucleic acids and/or immunogenic compositions described herein is effective to prevent and/or treat an influenza A and/or B virus infection caused by two, three, four, five or six subtypes of influenza A and/or B viruses. In some embodiments, the immune response induced is effective to prevent and/or treat an influenza virus infection caused by an influenza virus comprising HA of the H1 subtype.

Since it is well known that small proteins and/or nucleic acid molecules do not always efficiently induce a potent immune response it may be necessary to increase the immunogenicity of the polypeptides and/or nucleic acid molecules by adding an adjuvant. In certain embodiments, the immunogenic compositions described herein comprise, or are administered in combination with, an adjuvant. The adjuvant for administration in combination with a composition described herein may be administered before, concomitantly with, or after administration of said composition. Examples of suitable adjuvants include aluminium salts such as aluminium hydroxide and/or aluminium phosphate; oil-emulsion compositions (or oil-in-water compositions), including squalene-water emulsions, such as MF59 (see e.g. WO 90/14837); saponin formulations, such as for example QS21 and Immunostimulating Complexes (ISCOMS) (see e.g. U.S. Pat. No. 5,057,540; WO 90/03184, WO 96/11711, WO 2004/004762, WO 2005/002620); bacterial or microbial derivatives, examples of which are monophosphoryl lipid A (MPL), 3-O-deacylated MPL (3dMPL), CpG-motif containing oligonucleotides, ADP-ribosylating bacterial toxins or mutants thereof, such as *E. coli* heat labile enterotoxin LT, cholera toxin CT, pertussis toxin PT, or tetanus toxoid TT, Matrix M (Isconova). In addition, known immunopotentiating technologies may be used, such as fusing the polypeptides of the invention to proteins known in the art to enhance immune response (e.g. tetanus toxoid, CRM197, rCTB, bacterial flagellins or others) or including the polypeptides in virosomes, or combinations thereof. Other non-limiting examples that can be used are e.g. disclosed by Coffman et al. (2010).

In an embodiment, the influenza hemagglutinin stem domain polypeptides of the invention are incorporated into viral-like particle (VLP) vectors. VLPs generally comprise a viral polypeptide(s) typically derived from a structural protein(s) of a virus. Preferably, the VLPs are not capable of replicating. In certain embodiments, the VLPs may lack the complete genome of a virus or comprise a portion of the genome of a virus. In some embodiments, the VLPs are not capable of infecting a cell. In some embodiments, the VLPs express on their surface one or more of viral (e.g., virus surface glycoprotein) or non-viral (e.g., antibody or protein) targeting moieties known to one skilled in the art.

In a specific embodiment, the polypeptide of the invention is incorporated into a virosome. A virosome containing a polypeptide according to the invention may be produced using techniques known to those skilled in the art. For example, a virosome may be produced by disrupting a purified virus, extracting the genome, and reassembling particles with the viral proteins (e.g., an influenza hemagglutinin stem domain polypeptide) and lipids to form lipid particles containing viral proteins.

The invention also relates to the above-described polypeptides, nucleic acids, vectors and/or immunogenic compositions for inducing an immune response in a subject against influenza HA, in particular for use as a vaccine. The influenza hemagglutinin stem domain polypeptides, nucleic acids encoding such polypeptides, or vectors comprising such nucleic acids or polypeptides described herein thus may be used to elicit neutralizing antibodies against influenza viruses, for example, against the stem region of influenza virus hemagglutinin. The invention in particular relates to polypeptides, nucleic acids, and/or imunogenic compositions as described above for use as a vaccine in the prevention and/or treatment of a disease or condition caused by an influenza A virus of phylogenetic group 1 and/or phylogenetic group 2 and/or an influenza B virus. In an embodiment, the vaccine may be used in the prevention and/or treatment of diseases caused by two, three, four, five, six or more different subtypes of phylogenetic group 1 and/or 2 and/or influenza B viruses. In an embodiment, the vaccine may be used in the prevention and/or treatment of influenza infection caused by an influenza virus comprising HA of the H1 subtype.

The polypeptides of the invention may be used after synthesis in vito or in a suitable cellular expression system, including bacterial and eukaryotic cells, or alternatively, may be expressed in vivo in a subject in need thereof, by expressing a nucleic acid coding for the immunogenic polypeptide. Such nucleic acid vaccines may take any form, including naked DNA, plasmids, or viral vectors including adenoviral vectors.

Administration of the polypeptides, nucleic acid molecules, vectors and/or immunogenic compositions according to the invention can be performed using standard routes of administration. Non-limiting examples include parenteral administration, such as intravenous, intradermal, transdermal, intramuscular, subcutaneous, etc, or mucosal administration, e.g. intranasal, oral, and the like. The skilled person will be capable to determine the various possibilities to administer the polypeptides, nucleic acid molecules, and/or immunogenic compositions according to the invention, in order to induce an immune response. In certain embodiments, the polypeptide, nucleic acid molecule, and/or immunogenic composition (or vaccine) is administered more than one time, i.e. in a so-called homologous prime-boost regimen. In certain embodiments where the polypeptide, nucleic acid molecule, and/or immunogenic composition is administered more than once, the administration of the second dose can be performed after a time interval of, for example, one week or more after the administration of the first dose, two weeks or more after the administration of the first dose, three weeks or more after the administration of the first dose, one month or more after the administration of the first dose, six weeks or more after the administration of the first dose, two months or more after the administration of the first dose, 3 months or more after the administration of the first dose, 4 months or more after the administration of the first dose, etc, up to several years after the administration of the first dose of the polypeptide, nucleic acid molecule, and/or immunogenic composition. It is also possible to administer the vaccine more than twice, e.g. three times, four times, etc, so that the first priming administration is followed by more than one boosting administration. In other embodiments, the polypeptide, nucleic acid molecule, vectors and/or composition according to the invention is administered only once.

The polypeptides, nucleic acid molecules, vectors and/or compositions may also be administered, either as prime, or as boost, in a heterologous prime-boost regimen.

The invention further provides methods for preventing and/or treating an influenza virus disease in a subject utilizing the polypeptides, nucleic acids and/or compositions described herein. In a specific embodiment, a method for preventing and/or treating an influenza virus disease in a subject comprises administering to a subject in need thereof an effective amount of a polypeptide, nucleic acid molecule, vector and/or composition, as described above. A therapeutically effective amount refers to an amount of the polypeptide, nucleic acid, and/or composition as defined herein, that is effective for preventing, ameliorating and/or treating a disease or condition resulting from infection by a group 1 or 2 influenza A virus, and/or an influenza B virus, preferably a disease resulting from infection by an influenza A virus comprising HA of the H1 subtype and/or an influenza A virus comprising HA of the H3 subtype. Prevention encompasses inhibiting or reducing the spread of influenza virus or inhibiting or reducing the onset, development or progression of one or more of the symptoms associated with infection by an influenza virus. Amelioration as used in herein may refer to the reduction of visible or perceptible disease symptoms, viremia, or any other measurable manifestation of influenza infection.

Those in need of treatment include those already inflicted with a condition resulting from infection with a group 1 or a group 2 influenza A virus, or an influenza B virus, as well as those in which infection with influenza virus is to be prevented. The polypeptides, nucleic acid molecules, vectors and/or compositions of the invention thus may be administered to a naive subject, i.e., a subject that does not have a disease caused by influenza virus infection or has not been and is not currently infected with an influenza virus infection, or to subjects that already are and/or have been infected with an influenza virus.

In an embodiment, prevention and/or treatment may be targeted at patient groups that are susceptible to influenza virus infection. Such patient groups include, but are not limited to e.g., the elderly (e.g. ≥50 years old, ≥60 years old, and preferably ≥65 years old), the young (e.g. ≤5 years old, ≤1 year old), hospitalized patients and patients who have been treated with an antiviral compound but have shown an inadequate antiviral response.

In another embodiment, the polypeptides, nucleic acids molecules and/or vectors may be administered to a subject in combination with one or more other active agents, such as existing, or future influenza vaccines, monoclonal antibodies and/or antiviral agents, and/or antibacterial, and/or immunomodulatory agents. The one or more other active agents may be beneficial in the treatment and/or prevention of an influenza virus disease or may ameliorate a symptom or condition associated with an influenza virus disease. In some embodiments, the one or more other active agents are pain relievers, anti-fever medications, or therapies that alleviate or assist with breathing.

Dosage regimens of the polypeptides and/or nucleic acid molecules of the invention can be adjusted to provide the optimum desired response (e.g., a therapeutic response). A suitable dosage range may for instance be 0.1-100 mg/kg body weight, preferably 1-50 mg/kg body weight, preferably 0.5-15 mg/kg body weight. The precise dosage of the polypeptides and/or nucleic acid molecules to be employed will e.g. depend on the route of administration, and the seriousness of the infection or disease caused by it, and should be decided according to the judgment of the practitioner and each subject's circumstances. For example, effective doses vary depending target site, physiological state of the patient (including age, body weight, health), and whether treatment is prophylactic or therapeutic. Usually, the patient is a human but non-human mammals including transgenic mammals can also be treated. Treatment dosages are optimally titrated to optimize safety and efficacy.

The polypeptides of the invention may also be used to verify binding of monoclonal antibodies identified as potential therapeutic candidates. In addition, the polypeptides of the invention may be used as diagnostic tool, for example to test the immune status of an individual by establishing whether there are antibodies in the serum of such individual capable of binding to the polypeptide of the invention. The invention thus also relates to an in vitro diagnostic method for detecting the presence of an influenza infection in a patient said method comprising the steps of a) contacting a biological sample obtained from said patient with a polypeptide according to the invention; and b) detecting the presence of antibody-antigen complexes.

The polypeptides of the invention may also be used to identify new binding molecules or improve existing binding molecules, such as monoclonal antibodies and antiviral agents.

The invention is further illustrated in the following examples and figures. The examples are not intended to limit the scope of the invention in any way.

EXAMPLES

Example 1

Stem Based Polypeptides Disclosed in PCT/EP2014/060997

PCT/EP2012/073706 discloses influenza hemagglutinin stem domain polypeptides, compositions and vaccines and methods of their use in the field of prevention and/or treatment of influenza. PCT/EP2014/060997 discloses further sequences of stem domain polypeptides derived from the full length HA of H1N1 A/Brisbane/59/2007 (SEQ ID NO: 1), which were obtained by site-directed mutation of H1-mini2-cluster1+5+6-GCN4 (SEQ ID NO: 2) and which stably presented the broadly neutralizing epitope of CR6261 (Throsby et al, 2009; Ekiert et al 2010) and/or CR9114.

H1-mini2-cluster1+5+6-GCN4 (SEQ ID NO: 2) was derived from the full length HA of H1N1 A/Brisbane/59/2007 (SEQ ID NO: 1) by taking the following steps:

1. Removal of the cleavage site in HA0. Cleavage of wild type HA at this site results in HA1 and HA2. The removal can be achieved by mutation of R to Q at the P1 position (see e.g. Sun et al, 2010 for an explanation of the nomenclature of the cleavage site (position 343 in SEQ ID NO: 1).
2. Removal of the head domain by deleting amino acids 53 to 320 from SEQ ID NO; 1. The remaining N- and C-terminal parts of the sequence were joined by a four residue flexible linker, GGGG.
3. Increasing the solubility of the loop (between the A-helix and the CD helix) formed by (the equivalent of) residues 402 to 418 in H1 A/Brisbane/59/2007 (SEQ ID NO: 1) in order to both increase the stability of the pre-fusion conformation and to destabilize the post-fusion conformation of the modified HA. In H1-mini2-cluster1+5+6-GCN4 (SEQ ID NO: 2) mutations F406S, V409T, F413G and L416S (numbering refers to SEQ ID NO: 1) were introduced
4. Introducing a disulfide bridge between amino acids at position 324 and 436 in H1 A/Brisbane/59/2007; this is achieved by introducing mutations R324C and Y436C. (numbering refers to SEQ ID NO: 1)
5. Introducing the GCN4 derived sequence MKQIEDKIEE-IESKQ (SEQ ID NO: 5), that is known to trimerize, at position 419-433 (numbering refers to SEQ ID NO: 1).

In certain embodiments, the sequence of the transmembrane and intracellular domain was deleted from position (or the equivalent thereof, as determined from sequence alignment) 514, 515, 516, 517, 518, 519, 520, 521, 522, 523, 524, 525, 526, 526, 527, 528, 529, or 530 of HA2 to the C-terminus of HA2 (numbering according to SEQ ID NO: 1) so that a secreted (soluble) polypeptide was produced following expression in cells. The soluble polypeptide was further stabilized by introducing a sequence known to form trimeric structures, i.e. the foldon sequence GYIPEAPRDGQAYVRKDGEWVLLSTFL (SEQ ID NO: 3), optionally connected through a short linker, as described above. The linker may optionally contain a cleavage site for processing afterwards according to protocols well known to those skilled in the art. To facilitate purification and detection of the soluble form a tag sequence may be optionally added, e.g. a histidine tag (HHHHHHH (SEQ ID NO: 20) or HHHHHH (SEQ ID NO: 21) or a FLAG tag (DYKDDDDK; SEQ ID NO: 22) or combination of these, optionally connected via short linkers. The linker may optionally contain (part of) a proteolytic cleavage site, e.g. LVPRGS (SEQ ID NO: 23) (thrombin) or IEGR (SEQ ID NO: 24) (Factor X) for processing afterwards according to protocols well known to those skilled in the art. The processed proteins are also encompassed in the invention.

An example of such a C-terminal sequence combining FLAG-tag, thrombin cleavage site, foldon, and His sequences is SEQ ID NO: 4 FLAG-thrombin-foldon-His. This sequence was combined with a soluble form of H1-mini2-cluster1+5+6-GCN4 (SEQ ID NO: 2) sequence to create the parental sequence (SEQ ID NO: 6) that was used to create novel polypeptides of the invention by mutagenesis. This sequence does not contain the leader sequence corresponding to amino acids 1-17 of SEQ ID NO: 1 and 2.

Stem domain polypeptides thus were created by deleting the part of the hemagglutinin sequence that encodes the head domain of the molecule and reconnecting the N- and C-terminal parts of the sequence on either side of the deletion through a linker as described in PCT/2012/073706 and above. The removal of the head domain leaves part of the molecule that was previously shielded from the aqueous solvent exposed, potentially destabilizing the structure of the polypeptides of the invention. For this reason residues in the B-loop (in particular amino acid residue 406 (F and S in SEQ ID NO: 1 and 2, respectively), 409 (V and T) 413 (F and G) and 416 (L and S) were mutated in various combinations using parental sequence SEQ ID NO: 6 as the starting point. SEQ ID NO: 6 was created from H1-mini2-cluster1+5+6-GCN4 (SEQ ID NO: 2) by removing the leader sequence, and replacing residues 520-565 with a Flag-thrombin-foldon-his sequence (SEQ ID NO: 4).

Similarly, in the area around the fusion peptide a number of hydrophobic residues are exposed to the solvent, caused by the fact that, unlike the native full length HA, the polypeptides cannot be cleaved and undergo the associated conformational change that buries the hydrophobic fusion peptide in the interior of the protein. To address this issue some or all of the residues I337, I340, F352 and I353 in SEQ ID NO: 2 were also mutated.

This way, the soluble forms of HA stem polypeptides 74H9 (SEQ ID NO: 57), 127H1 (SEQ ID NO: 55), 71H2 (SEQ ID NO: 61), 86B4 (SEQ ID NO: 56), 115A1 (SEQ ID NO: 60), 2201C9 (SEQ ID NO: 63), 55G7 (SEQ ID NO: 59), 113E7 (SEQ ID NO: 64), 6E12 (SEQ ID NO: 58), 181H9 (SEQ ID NO: 62) were created as part of a library.

DNA sequences encoding the polypeptides described above were transformed into *Pichia pastoris* or transfected into HEK293F cells using protocols well known to persons skilled in the art. Constructs used for expression in mammalian cells contained the HA leader sequence (residue 1-17 in SEQ ID NO: 1 and 2), whereas in constructs used for expression in *P. pastoris* the HA leader sequence was replaced with the yeast alpha factor leader sequence (SEQ ID NO: 7). In this way expressed protein are directed towards the cell culture medium thus allowing binding and expression to be determined without further purification of the polypeptides of the invention. All sequences contained the FLAG-foldon-HIS C-terminal sequence (SEQ ID NO: 4).

Monoclonal antibody binding (CR6261, CR9114, CR8020) to polypeptides of the invention was determined by ELISA. To this end ELISA plates were treated overnight with a 2 µg/ml monoclonal antibody solution (20 µl/well) at 4° C. After removal of the antibody solution the remaining surface was blocked with 4% solution of non-fat dry milk powder in PBS for a minimum of 1 h at room temperature. After washing of the plates, 20 µl of cell culture medium (neat or diluted) was added to each well and incubated for at least 1 h at room temperature. ELISA plates were then washed and 20 µl of anti-FLAG-HRP antibody solution (Sigma A8952, 2000 times diluted in 4% non-fat dry milk in PBS-Tween) was added. After incubation (1 h at room temperature) plates were washed once more, and 20 µl luminescent substrate (Thermoscientific C#34078) was added to develop the signal. Alternatively, a colorimetric detection method can be used to develop the signal.

Expression of polypeptides of the invention was determined from a homogeneous time-resolved fluorescence assay (for a general description see e.g. Degorce et al., Curr. Chem. Genomics 2009 3: 22-32). To this end a mixture of Terbium (Tb) labeled anti-FLAG monoclonal antibody (donor) and Alexa488 labeled anti-His monoclonal antibody (acceptor) (HTRF solution) was prepared by adding 210.5 µl Anti-FLAG-TB (stock solution 26 µg/ml) and 1.68 ml of anti-HIS-488 (stock solution 50 µg/ml) to 80 ml of a 1 to 1 mixture of culture medium and 50 mM HEPES+0.1% BSA. 19 µl of HTRF solution was added to each well of a ELISA plate and 1 µl of culture medium was added. Upon excitation and after a delay to allow interfering short-lived background signals arising from other compounds (proteins, media components etc) to decay, the ratio of fluorescence emission at 520 and 665 nm was determined. This is a measure of total protein content in the sample and is used to normalize the mAb binding signals between different experiments.

The polypeptides listed in Table 3 and 4 were expressed in *P. Pastoris* following protocols well known to those skilled in the art. Culture medium was collected and binding to CR6261 binding of and expression of the stem domain polypeptides was determined as described above. Since the response in the binding assay scales with the concentration of expresses protein, ELISA binding signal was normalized for protein expression by comparing the ratio of binding signal over the signal in the HTRF assay for each expressed sequence. All expressed protein exhibit higher ratio's of CR626 binding to HTRF signal compared to the parental sequence of SEQ ID NO: 6.

In addition, the ratio of CR6261 binding to HTRF signals was calculated and compared to the ratio calculated for the parental sequence SEQ ID NO: 6. The results are listed in column 5 of Tables 3 and 4; all expressed proteins exhibit higher ratios, indicating that the stem polypeptides described above show increased binding of CR6261.

Example 2

Design and Characterization of Further Polypeptides

The polypeptides described above contain sequence RMKQIEDKIEEIESKQ, derived from yeast transcriptional activator protein GCN4, in the CD helix. This sequence has a high propensity to form helical secondary structures and can enhance in this way overall stability of the polypeptide of the invention. It has surprisingly been found that stability and aggregation state of the hemagglutinin stem polypeptides is dependent on the exact location and sequence of the GCN4 derived sequence in the primary sequence of the polypeptides.

In this example, we describe a novel set of polypeptides wherein sequence RMKQIEDKIEEIESK (SEQ ID NO: 20) has been introduced at position 419-433 (numbering according to SEQ ID NO: 1, for example SEQ ID NO. 81 to 110) or sequence RMKQIEDKIEEIESKQK (SEQ ID NO: 21) has been introduced at position 417-433 (for example SEQ ID NO 111 to 140).

To this end, the polypeptides described in Example 1, i.e 74H9 (SEQ ID NO: 57), 127H1 (SEQ ID NO: 55), 71H2 (SEQ ID NO: 61), 86B4 (SEQ ID NO: 56), 115A1 (SEQ ID NO: 60), 2201C9 (SEQ ID NO: 63), 55G7 (SEQ ID NO: 59), 113E7 (SEQ ID NO: 64), 6E12 (SEQ ID NO: 58), 181H9 (SEQ ID NO: 62) were modified, using techniques of molecular biology well known to those skilled in the art, to create sequences 74H9-t2 (SEQ ID NO: 83), 127H1-t2 (SEQ ID NO: 81), 71H2-t2 (SEQ ID NO: 87), 86B4-t2 (SEQ ID NO: 82), 115A1-t2 (SEQ ID NO: 86), 220C9-t2 (SEQ ID NO: 89), 55G7-t2 (SEQ ID NO: 85), 113E7-t2 (SEQ ID NO: 90), 6E12-t2 (SEQ ID NO: 84), 181H9-t2 (SEQ ID NO: 88) containing sequence RMKQIEDKIEEIESK (SEQ ID NO: 20) at position 419-433.

In a similar manner sequences 74H9-t3 (SEQ ID NO: 113), 127H1-t3 (SEQ ID NO: 111), 71H2-t3 (SEQ ID NO: 117), 86B4-t3 (SEQ ID NO: 112), 115A1-t3 (SEQ ID NO: 116), 2201C9-t3 (SEQ ID NO: 119), 55G7-t3 (SEQ ID NO: 115), 113E7-t3 (SEQ ID NO: 120), 6E 2-t3 (SEQ ID NO: 114), 181H9-t3 (SEQ ID NO: 118) containing sequence RMKQIEDKIEEIESKQK (SEQ ID NO: 21) at position 417-433 were created.

Polypeptides can also be created on the basis of the sequence of HA molecules from different viral strains. SEQ ID NO: 195-201 for example describe polypeptides based on the HA sequence of the H1N1 A/California/07/09 strain.

As described before, soluble polypeptides can be created by removing the C-terminal part of the HA based sequences for example from residue 514, 515, 516, 517, 518, 519, 520, 521, 522, 523, 524, 525, 526, 527, 526, 528, 529, or 530 of the HA2 domain to the C-terminus of the HA2 domain (numbering according to SEQ ID NO: 1).

The polypeptides can further be stabilized by introducing a sequence known to form trimeric structures, i.e GYIPEAPRDGQAYVRKDGEWVLLSTFL (SEQ ID NO: 3), optionally connected through a linker. The linker may optionally contain a cleavage site for processing afterwards according to protocols well known to those skilled in the art. To facilitate purification of the soluble form a tag sequence may be added, e.g. a his tag (HHHHHHH (SEQ ID NO: 15) or HHHHHH (SEQ ID NO: 16)) or FLAG tag (DYKDDDDK) (SEQ ID NO: 22) or a combination of these, optionally connected via short linkers. The linker may optionally contain (part of) a proteolytic cleavage site, e.g. IEGR (SEQ ID NO: 24) (Factor X) or LVPRGS (SEQ ID NO: 23) (thrombin) for processing afterwards according to protocols well known to those skilled in the art.

Soluble forms of the polypeptides of SEQ ID NO 55-64 and 81-90 were created by replacement of the equivalent of residue 519-565 (numbering refers to SEQ ID NO: 1) with sequence RSLVPRGSPGHHHHHH, containing both a modified thrombin cleavage site and a 6 histidine tag (SEQ ID NO: 21) and were expressed in HEK293F cells following protocols well known to those skilled in the art.

For reasons of comparison, soluble forms of H1-mini2-cluster1+5+6-GCN4t2 (SEQ ID NO:52) and H1-mini2-cluster1+5+6-GCN4t3 (SEQ ID NO: 53)), described in PCT/EP2012/073706 were also included in the experiments. Culture medium was collected and binding to CR6261, CR9114 was detected by a sandwich ELISA, using coated mAb CR6261 or CR9114 to capture the polypeptide directly from the culture medium and a Horse Radish Peroxidase (HRP) conjugated antibody directed against the C-terminal his-tag for detection purposes. Alternatively, biotinylated CR9114 in combination with HRP-conjugated streptavidin was used for detection of CR9114 captured polypeptides in a sandwich ELISA. This format allows the detection of the presence of multimeric forms of polypeptides. All polypeptides tested were capable of binding to CR9114 and CR6261 as determined by ELISA. Increased levels of multimerization as detected by the CR9114 capture—biotinylated CR9114 detection sandwich ELISA were observed for s55G7-t2 (SEQ ID NO: 95), s86B4-t2 (SEQ ID NO: 92), s115A1-t2 (SEQ ID NO: 96), s127H1-t2 (SEQ ID NO: 91), s113E7-t2 (SEQ ID NO: 100), s220C9-t2 (SEQ ID NO: 99), s71H2-t3 (SEQ ID NO: 127), s127H1-t3 (SEQ ID NO: 121), s74H9-t3 (SEQ ID NO: 123).

In order to obtain a highly pure preparations of the polypeptides for further characterization, HEK293F cells were transfected with expression vector pcDNA2004 containing the genes encoding soluble forms of 127H1-t2 (SEQ ID NO: 81), 86B4-t2 (SEQ ID NO: 82) and 55G7-t2 (SEQ ID NO: 85). It will be understood by the skilled person that the leader sequence (or signal sequence) that directs transport of a protein during production (corresponding to amino acids 1-17 of SEQ ID NO: 1) will not be present in the secreted final polypeptide.

To produce the polypeptides $1.0*10^6$ vc/mL were seeded by spinning down HEK293F cells (Invitrogen) at 300 g for 5 min and resuspending in 300 mL pre-warmed Freestyle™ medium per SF1000 flask. This culture was incubated for 1 hour at 37° C., 10% CO2 at 110 rpm in a multitron incubator. After 1 hour the plasmid DNA was pipetted in 9.9 mL Optimem medium to a concentration of 1.0 µg/mL in the 300 mL culture volume. In parallel 440 µL 293Fectin® was pipetted in 9.9 mL Optimem medium and incubated for 5 minutes at room temperature. After 5 minutes the plasmid DNA/Optimem mix was added to the 293Fectin®/Optimem mix and incubated at room temperature for 20 minutes. After the incubation the plasmid DNA/293Fectin® mix was added drop wise to the cell suspension. The transfected cultured was incubated at 37° C., 10% CO2 and 110 rpm in a multitron incubator. At day 7 cells were separated from the culture medium by centrifugation (30 minutes at 3000 g), while the supernatant containing the soluble polypeptides was filtrated over a 0.2 µm bottle top filter for further processing.

For purification purposes 1500 ml (s127H1_t2), 1800 ml (s86B4_t2), and 2400 ml (s55G7_t2) of culture supernatant was applied to a 24 ml Ni Sepharose HP column, pre-equilibrated in wash buffer (20 mM TRIS, 500 mM NaCl, pH 7.8). Following a washing step with 10 mM Imidazole in wash buffer the bound polypeptides were eluted with a step-wise gradient of 300 mM imidazole in wash buffer. The elution peaks were collected, concentrated, and applied to a size exclusion column for further purification (Superdex 200 For 55G7-t2 and 127H1-t2 fractions were collected and pooled. analyzed by SDS-PAGE), ELISA and analytical size exclusion chromatography combined with multi-angle light scattering to estimate molecular mass (SEC-MALS). ELISA results confirmed binding of the polypeptides to CR6261 and CR9114, but not CR8020. SEC-MALS results are summarized in table 9.

Table 8 indicates that polypeptide s127H1-t2 has a high yield (~30 mg protein/l culture supernatant) compared to 55G7-t2 and 86B4-t2. The majority of the protein exhibits a molecular weight of 62 kDa, which is in between what is expected for a monomer or a dimer. To confirm the aggregation state of the protein the SEC-MALS experiment was repeated in the presence of Fab-fragments derived from CR6261, CR9114 and CR8020. Results are summarized in Table 8.

The results show that the soluble form of polypeptide s127H1-t2 forms a complex (as evidenced by the shift of the peak in SEC chromatogram) in the presence of the Fab fragments from CR6261 and CR9114, but not with CR8020. This is in line with the specificity of the binding reactions of the Fab fragments, since CR6261 and CR9114 bind to HA's derived from group 1, whereas CR8020 does not. The size of the complex is listed in table s, and indicates that polypeptide s127H1-t2 binds one to two Fab fragments, indicating that at least part of the population of purified polypeptide s127H1-t2 is in dimeric form.

To further analyze the binding reaction between polypeptide 127H1-t2 and mAb's CR6261 and CR9114, as well as to confirm the presence of the conformational epitopes of CR6261 and CR9114 the complexation of these antibodies with the purified protein was studied by biolayer interferometry (Octet Reds[384], Forte Bio). To this end, biotinylated CR6261, CR9114 and CR8020 were immobilized on streptavidin coated sensors, which subsequently were exposed first to a solution of the purified polypeptide to measure the rate of association and then to a wash solution to measure the rate of dissociation.

The immobilized CR6261 and CR9114 both recognize the as evidenced by a clear responses after exposure to the soluble form of 127H1-t2. In conclusion polypeptide s127H1-t2 is produced in high quantities and is capable of binding broadly neutralizing monoclonal antibodies CR6261 and CR9114 with high affinity, confirming the presence of the corresponding neutralizing epitopes in this stem domain polypeptide. The polypeptide has a propensity to form dimeric structures.

Example 3

Disulfide Stabilized Trimers of the Present Invention

One way to improve the presentation of neutralizing epitopes on immunogen in a vaccine is to engineer additional interactions between monomer immunogens in order to create multimeric species with increased stability compared to the monomer. A disadvantage of this method is that by bringing together the monomeric immunogens important epitopes can potentially be covered by the next protomer. Therefore care should be taken to avoid this. Polypeptides of the invention described here are derived from the hemagglutinin molecule of influenza. This molecule is a trimer in its native state on the viral membrane. Here we describe modified polypeptides of the invention that form stable trimers in solution while exposing the epitopes of neutralizing mAb CR6261 and CR9114.

To generate a trimeric polypeptide of the invention stabilizing interactions promoting trimerization of monomeric species of HA-stem based polypeptides were designed, focusing in particular on creating covalent disulfide bridges between individual monomers in the trimer. To this end the three dimensional structures of FL HA from H1N1 A/South Carolina/1./18 (PDB 1RD8) in its uncleaved state and H1N1 A/California/04/2009 (PDB: 3LZG) were analyzed to identify areas where the proximity of another monomer and the conformational features of the protein could potentially allow the formation of an intermonomer disulfide bridge. Eleven pairs of residues for which the inter-residue distance was less than 3.5 Å were identified (table 9). Care was taken to ensure that for each pair the residues were located on a different protomer (monomer) in the trimeric structure. The equivalent of these residues (as determined from sequence alignment) in polypeptide 127H1-t2 (SEQ ID NO: 160 to 170 and 55G7-t2 (SEQ ID NO: 149-159) were mutated into cysteine, with the intent to form trimeric polypeptides covalently linked through formation of disulfide bridges. Taking into account the 3-fold symmetry of the trimeric HA molecule successful designs lead to formation of three interprotomer disulfide bridges, covalently connecting each of the monomers in the trimer to the two other monomers.

To test for the presence of the designed disulfide bridges and the neutralizing epitopes of CR9114 and CR6261, soluble forms of the designed polypeptides were expressed in HEK293F cells. Soluble forms were created by deleting the equivalent of residue 530-565 (numbering refers to SEQ ID NO: 1) from SEQ ID NO: 149 to 170 to create polypeptides SEQ ID NO: 171 to 192. An additional sequence EGRHHHHHHH (SEQ ID NO: 19) was added at the C-terminus, in effect introducing a 7 histidine purification tag preceded by a Factor X proteolytic cleavage site to aid with purification and/or detection.

To produce the polypeptides $1.0*10^6$ vc/mL were seeded by spinning down HEK293F cells (Invitrogen) at 300 g for 5 min and resuspending in 30 mL pre-warmed Freestyle™ medium per SF250 flask. This culture was incubated for 1 hour at 37° C., 10% CO2 at 110 rpm in a multitron incubator. After 1 hour the plasmid DNA was pipetted in 1 mL Optimem medium to a concentration of 1.0 μg/mL in the 30 mL culture volume. In parallel 44 μL 293Fectin® was pipetted in 1 mL Optimem medium and incubated for 5 minutes at room temperature. After 5 minutes the plasmid DNA/Optimem mix was added to the 293Fectin®/Optimem mix and incubated at room temperature for 20 minutes. After the incubation the plasmid DNA/293fectin mix was added drop wise to the cell suspension. The transfected cultured was incubated at 37° C., 10% CO2 and 110 rpm in a multitron incubator. At day 7 cells were separated from the culture medium by centrifugation (30 minutes at 3000 g), while the supernatant containing the soluble polypeptides of the invention was filtrated over a 0.2 μm bottle top filter for further processing.

Culture medium was collected and was analyzed in a sandwich ELISA for the presence of multimeric forms of polypeptides that present two or more epitopes of the broadly neutralizing antibody CR9114. First. CR9114 coated plates were used to capture the expressed polypeptides directly from the culture medium. Second, biotinylated CR9114 in combination with HRP-conjugated streptavidin was used for detection of CR9114 captured polypeptides of the invention. As a control soluble purified full length HA from H1N1 A/Brisbane/59/2007 in trimeric and monomeric form was included in the assay (FIG. 2A). The results are shown in FIG. 2.

The trimeric full length HA shows a clear signal at low dilution, but at a concentration of approximately 0.0001 μg/ml and lower this signal is no longer detectable (FIG.

2A). For the monomeric full length HA a signal is also observed at low dilution but intensity is much lower and the signal is no longer detectable at approximately 0.02 µg/ml and lower. Most likely the signal is caused by some residual trimer that could not be separated from monomer during purification or has formed from the monomer over time. Soluble forms of H1 mini2-cluster1+5+6-GCN4 (SEQ ID NO: 52) (FIG. 2A) and, 127H1 (SEQ ID NO:55) FIG. 2B only show low intensity signals, indicating low concentrations or the absence of multimeric polypeptides exhibiting the epitope of CR9114 in solution. A soluble forms of 127H1-t2 (SEQ ID NO: 81) FIG. 2B exhibits a clear response in this assay, indicating the presence of some multimeric species but the intensity of the observed signals are low compared to the full length HA trimer.

Figure 2:
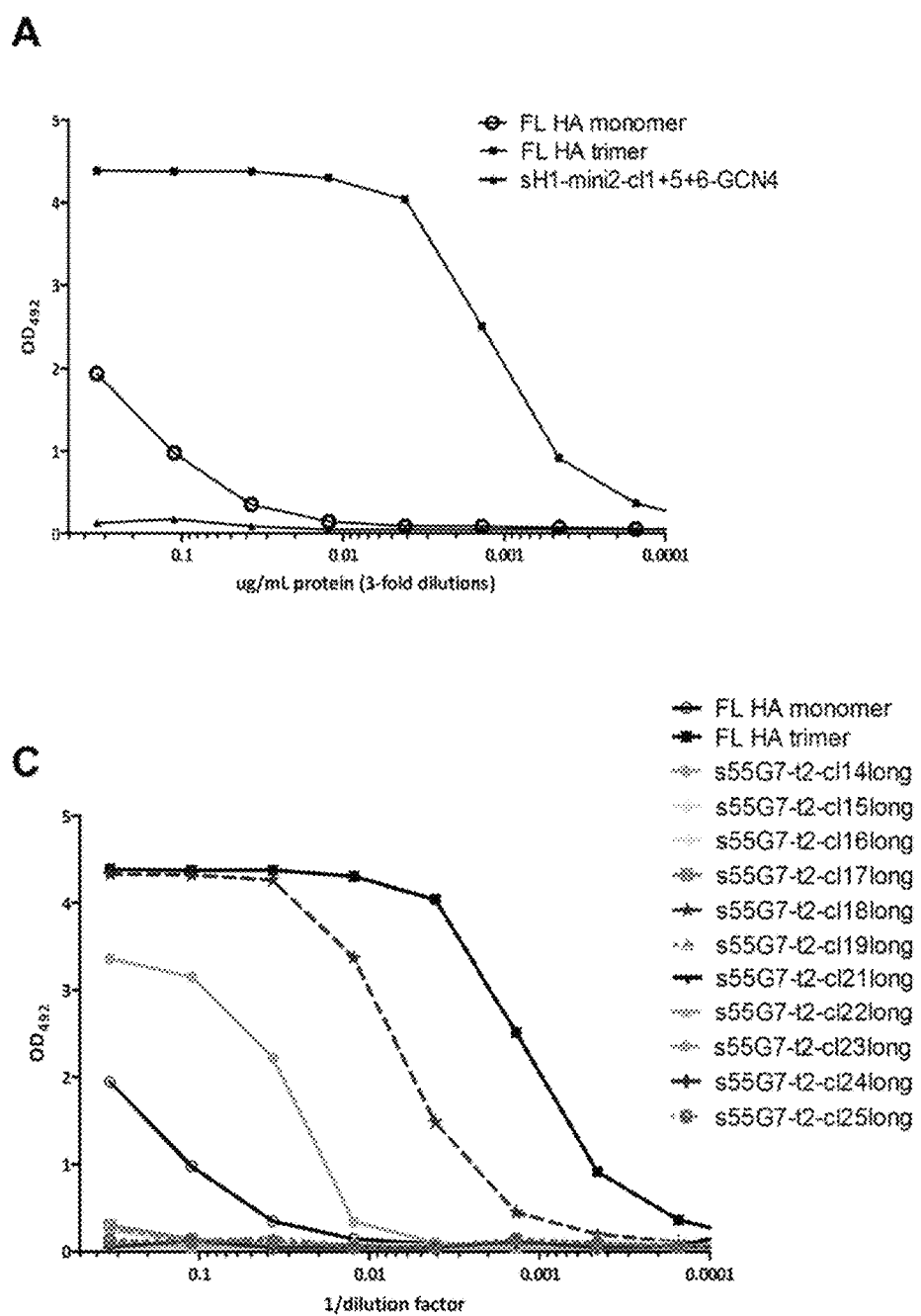
FIG. 2. CR9114 sandwich ELISA results for:

(A) purified soluble HA from H1N1 A/Brisbane/59/2007 in trimeric and monomeric form (B) medium obtained from cultures expressing s127H1 (SEQ ID NO: 66), s127H1-t2 (SEQ ID NO: 91); data for FL HA trimer and monomer are also show for reasons of comparison (C) double cysteine mutants variants of 55G7-t2 (SEQ ID NO: 166 to 176)

(D) double cysteine variants of 127H1-t2 (SEQ ID NO: 177 to 187)

The results for the soluble polypeptides based on 55G7-t2 with additional introduced cysteines are shown in FIG. 2C. For most peptides no or only very low signals are observed, indicating that no multimeric species presenting the epitope of CR9114 is present in the culture medium. A notable exception is polypeptide s55G7-t2-cl18long (SEQ ID NO: 175; additional cysteines introduced at positions 411 and 419; numbering refers to SEQ ID NO: 1). The only other polypeptide that shows a detectable response is s55G7-t2-cl14long (SEQ ID NO: 171; additional cysteines introduced at position 423 and 424) but signals are lower and disappear at lower dilution.

The results for the polypeptides based on 127H1-t2 are shown in FIG. 2D. In this case a clear response is observed for the polypeptides s127H1-t2-cl14long (SEQ ID NO: 182; additional cysteines at position 423 and 424), s127H1-t2-cl15long (SEQ ID NO: 183; additional cysteines at 430 and 431), s127H1-t2-cl17long (SEQ ID NO: 185; additional cysteines at 405 and 429), and s127H1-t2-cl24long (SEQ ID NO: 191; additional cysteines at 344 and 467), and to a lesser extent for s127H1-t2-cl19long (SEQ ID NO: 187: additional cysteines at 38 and 390) and s127H1-t2-cl23long (SEQ ID NO: 190; additional cysteines at 342 and 460). A low but detectable response is observed for s127H1-t2-cl61long (SEQ ID NO: 184; additional cysteines at 404 and 433). However, as in the case of 55G7-t2 the best result is obtained for variant s127H1-t2-cl18long with additional cysteines introduced at positions 411 and 419 (SEQ ID NO: 186)

Figure 3:
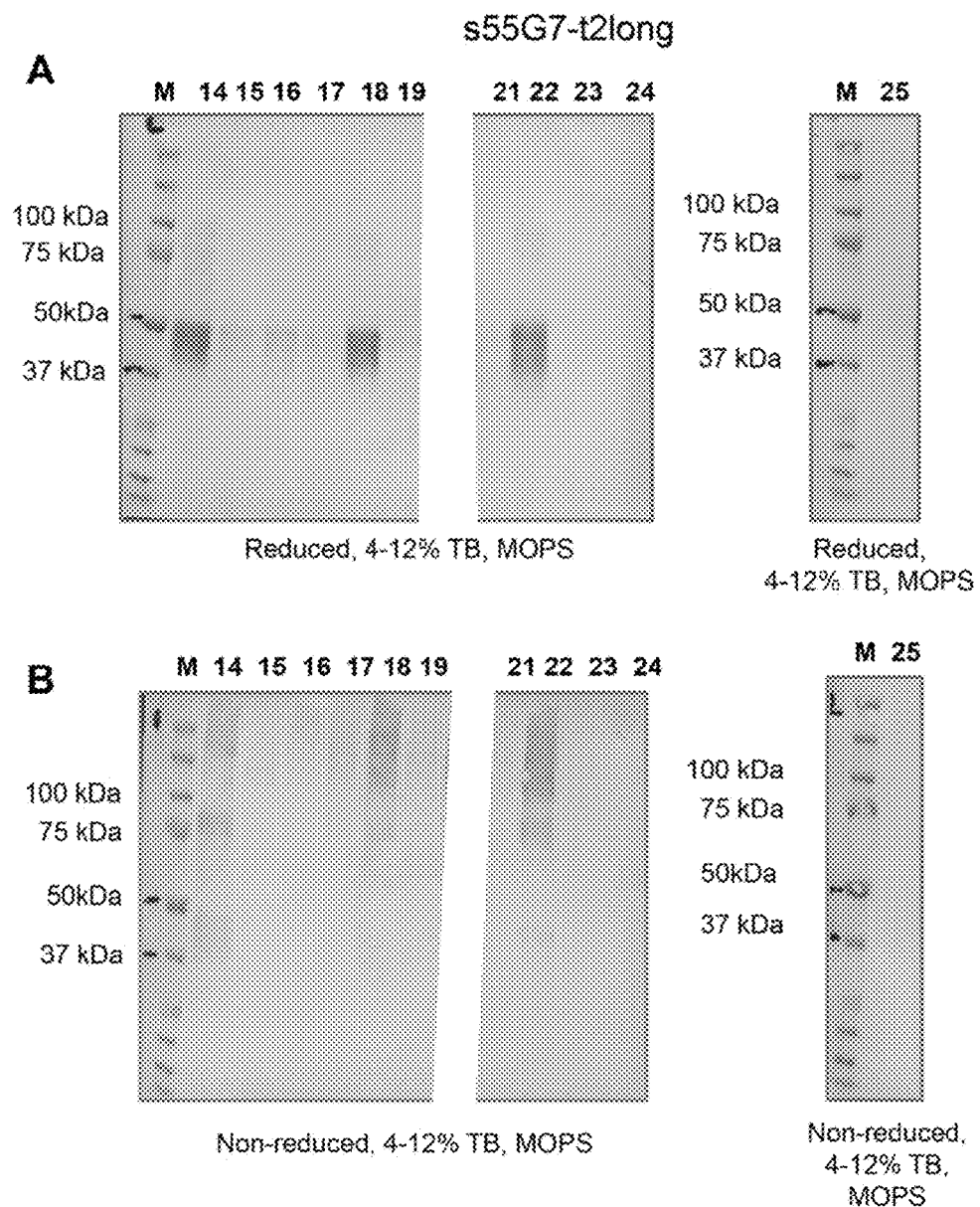
FIG. 3. Western blot of media of cultures expressing double cysteine variants of 55G7 (A, B) and 127H1-t2 (C,D) under reducing (A, C) and under non-reducing conditions (B, D). The numbers above each lane refer to the cluster of cysteine mutations as listed in table 10.

To further characterize the polypeptides of the invention with additional cysteines the culture supernatant was analysed by Western Blot using protocols well established in the art. For detection purposes a polyclonal antibody directed against the HA-protein of H1N1 (A/California/04/2009) was used. For a trimer under non-reducing conditions, i.e. when disulfide bridges are intact a protein band at ~90 kDa or above (depending on extent of glycosylation) is expected, whereas under reducing conditions a band close to 35 kD (corresponding to the glycosylated monomeric polypeptide of the invention) is expected. The results are shown in FIGS. 3A and B. For additional cysteine containing variants of 55G7-t2 under reducing conditions strong signals are observed for s55G7-t2-cl18long and s55G7-t2-cl22long, and to a lesser extent s55G7-cl14long. Under non-reducing conditions a smear of proteins of different sizes above 100 kDa was observed for s55G7-t2-cl18long and s55G7-t2-cl22long, indicating that covalently cross-linked stem domain polypeptides are present in these samples. A smear is also observed for s55G7-cl14long, but intensity is lower than observed for s55G7-cl18 and s55G7-cl22.

Figure 4:
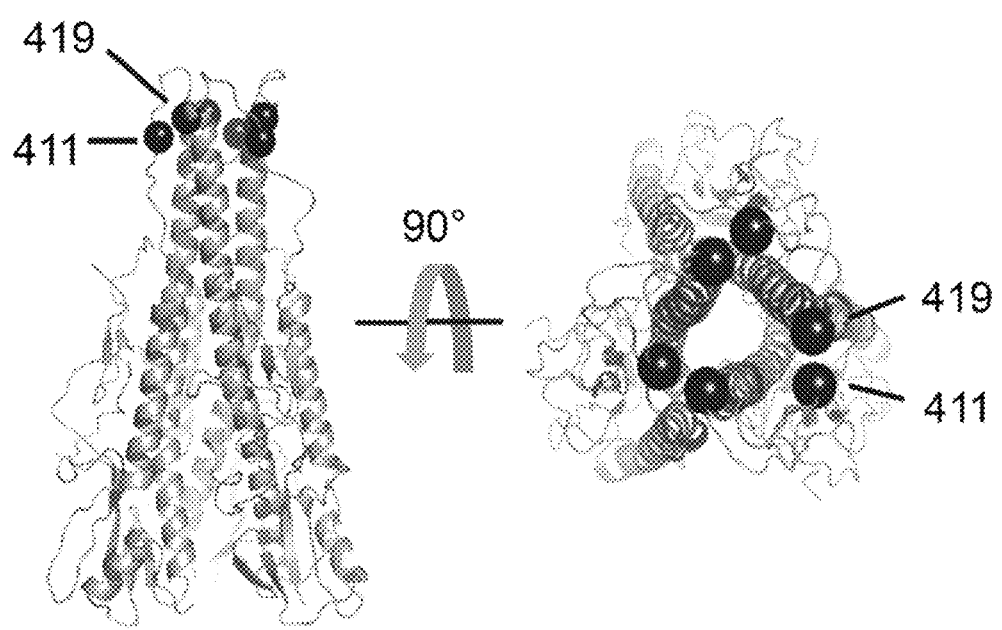
FIG. 4. Structural model of a polypeptide of the invention, indicating the positions of residues 411 and 419 that are mutated to cysteine in 127H1-t2-cl18. The model is created by deletion of residues 53 to 320 from the structure of the full length HA of H1N1 A/California/04/2009 (PDB 3LZG).

The results for the Western Blots of the additional cysteine containing polypeptides derived from 127H1-t2 under reducing conditions (FIG. 3C) indicate strong signals for s127H1-t2-cl14long, s127H1-t2-cl15long, s127H1-t2-cl16long, s127H1-t2-cl17long, and s127H1-t2-cl18long. For s127H1-t2-cl17long and s127H1-t2-cl18long a defined protein band close to 100 kDa is observed under non-reducing conditions (FIG. 3D), indicative of the presence of covalently cross-linked stem domain polypeptides. Polypeptides s127H1-t2-cl14long and s127H1-t2-cl15long also show some intensity around 100 kDa on the Western blot but signal is not as strong as for s127H1-t2-cl17long, and in particular si 27H1-t2-cl18long. The disulfide bridge (cl18) in this construct connects the B-loop of one monomer to the top of the CD-helix of another monomer as indicated in FIG. 4 and gave the strongest results in both in the background of 55G7-t2 and 127H1-t2.

Lu et al (PNAS 2013) describe a HA stem domain polypeptide that contains multiple intermonomer disulphide bridges. Their construct is produced in an *E. coli* based cell free system and is in contrast to the proteins described here an unfolded protein and needs to be refolded. The stem based polypeptide by Lu et al contains a foldon trimerization domain at the C-terminus and monomers are covalently connected through multiple disulphide bonds. Disulfide bonds described are located either in the foldon trimerization domain or in the HA derived part of the HA-stem polypeptide. Four potential disulphide bonds in the HA derived part of the polypeptide are described, including cysteines at position 423 and 424 (cluster 14) and 430 and 431 (cluster 15). In the described stem domain polypeptide the best results were obtained with cysteines at positions 430 and 431 (cluster 15), although trimerization could also be observed for cysteines at position 423 and 424 (cluster 14). In both cases an additional disulfide bridge was present in the C-terminal foldon domain. Surprisingly, results here show that in the absence of a disulfide linked C-terminal trimerization domain an engineered disulfide covalently connecting two different monomers through cysteines at position 411 and 419 leads to higher amounts of trimeric stem domain polypeptide. In conclusion we have shown that introduction of strategically placed disulphide pairs can lead to multimerization of HA stem based polypeptides. In particular simultaneous introduction of cysteines at position 411 and 419 (cluster 18) leads to formation of multimeric species in solution as evidenced from the Western Blot and sandwich Elisa results.

Example 4

Purification and Characterization of Trimeric Polypeptide of the Invention

To further characterize the polypeptide of the invention 127H1-t2-cl18, the protein was purified. To facilitate purification the transmembrane and cytosolic domain at the C-terminal end of the protein can be removed as described above to create a soluble version of the protein. It will be understood by the skilled person that the leader sequence (or signal sequence) that directs transport of a protein during production (corresponding to amino acids 1-17 of SEQ ID NO: 1) will not be present in the secreted final polypeptide. A non-limiting example of a soluble polypeptides of the invention is s127H-t2-cl18long (SEQ ID NO: 186).

Figure 5:
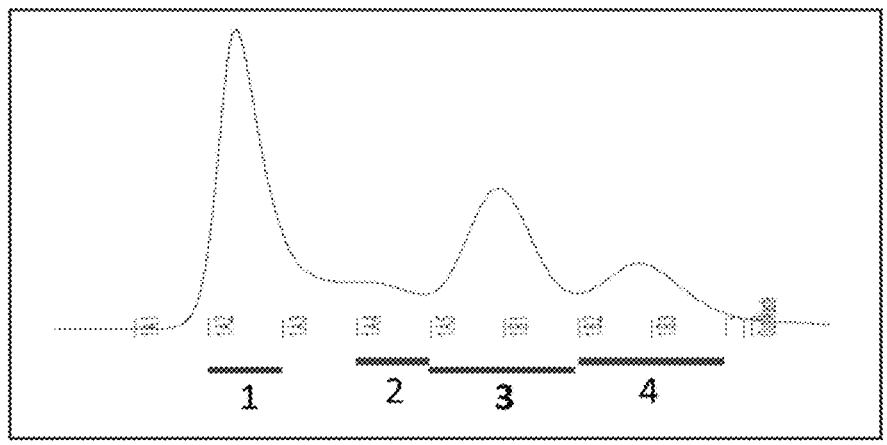
FIG. 5. (A). Elution profile from the preparative size exclusion column (Superdex 200) during purification of s127H1-t2-cl18long (SEQ ID NO: 181) with an additional C-terminal his-tag. Fractions are indicate below the figure.
Figure 5:
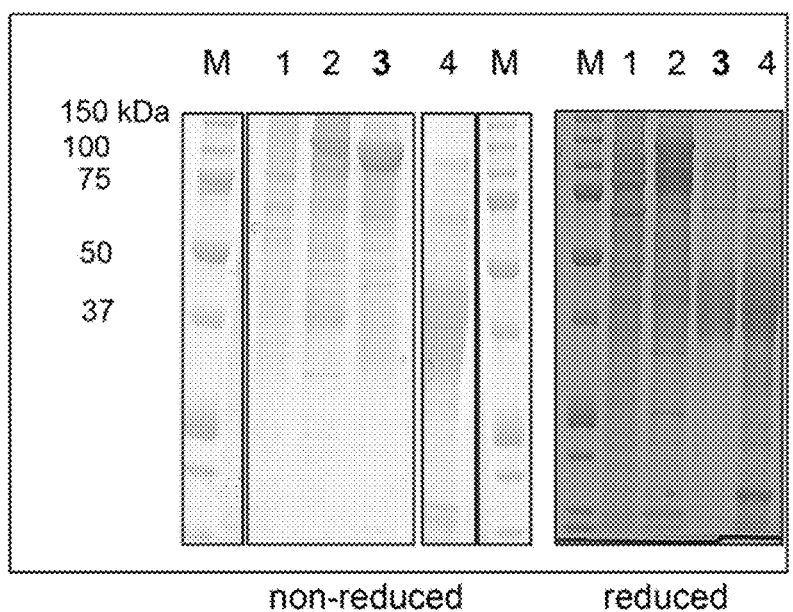

In order to obtain a highly pure preparation of a polypeptide of the invention, HEK293F cells were transfected with expression vector pcDNA2004 containing the gene encoding of polypeptide of the invention s127H1-t2-cl18long (SEQ ID NO: 186) containing an additional C-terminal his tag sequence (EGRHHHHHHH) and cultured for 7 days following protocols well established in the art. For purification purposes 300 ml of culture supernatant was applied to a 5 ml His Trap column, pre-equilibrated in wash buffer (20 mM TRIS, 500 mM NaCl, pH 7.8). Following a washing step with 10 mM Imidaze in wash buffer the bound polypeptide of the invention was eluted with a step-wise gradient of 300 mM imidazole in wash buffer. The elution peaks were collected, buffer exchanged, concentrated, and applied to a size exclusion column for further purification (Superdex 200). The elution profile is shown in FIG. 5A, fractions 1-4 were collected as indicated in the figure and analyzed by SDS-PAGE (FIG. 5B), NATIVE PAGE (FIG. 5C) and Western blot (FIG. 5D).

Under non-reducing conditions SDS PAGE shows a clear band for fraction 2 and 3 between 100 and 150 kD, as expected for a covalent linked trimeric polypeptide of the invention, whereas fraction 4 shows a diffuse band centered around 37 kD, close to the size expected for a monomeric polypeptide of the invention. The variation in size is a result from the variation in the extent of glycosylation of the polypeptide and has been observed for other stem domain polypeptides derived from HA. Upon reduction of disulfide bridges the major band in fraction 3 shifts to ca 37 kD, very similar to the band observed for fraction 4 indicating that reduction leads to monomerization. For fraction 2 the shift cannot clearly be discerned. Fraction 1 shows proteins of a range of sizes without a clear major band.

Native PAGE (non-reducing conditions) shows a clear difference in size between the protein in fraction 3 and 4, with major bands between 146-240 kD, and below 66 kD, respectively. For fraction 2 a weak signal between 146 and 240 kD is observed, whereas no protein can be detected for fraction 1, probably due to formation of large aggregates.

The Western blot data (non-reducing conditions) using a polyclonal anti-His for detection confirm that the major band in fraction 3 is histidine tagged material since a clear band is observed between 100 and 150 kD. For fraction 2 a weak signal is observed around the expected size of a trimer, but higher order oligomers are also detected, whereas for fraction 4 a weak and diffuse signal is observed around 37 kD. These data confirm that the major bands in fraction 2, 3 and 4 are derived from H1 HA. No signal was observed for the protein in fraction 1.

Figure 6:
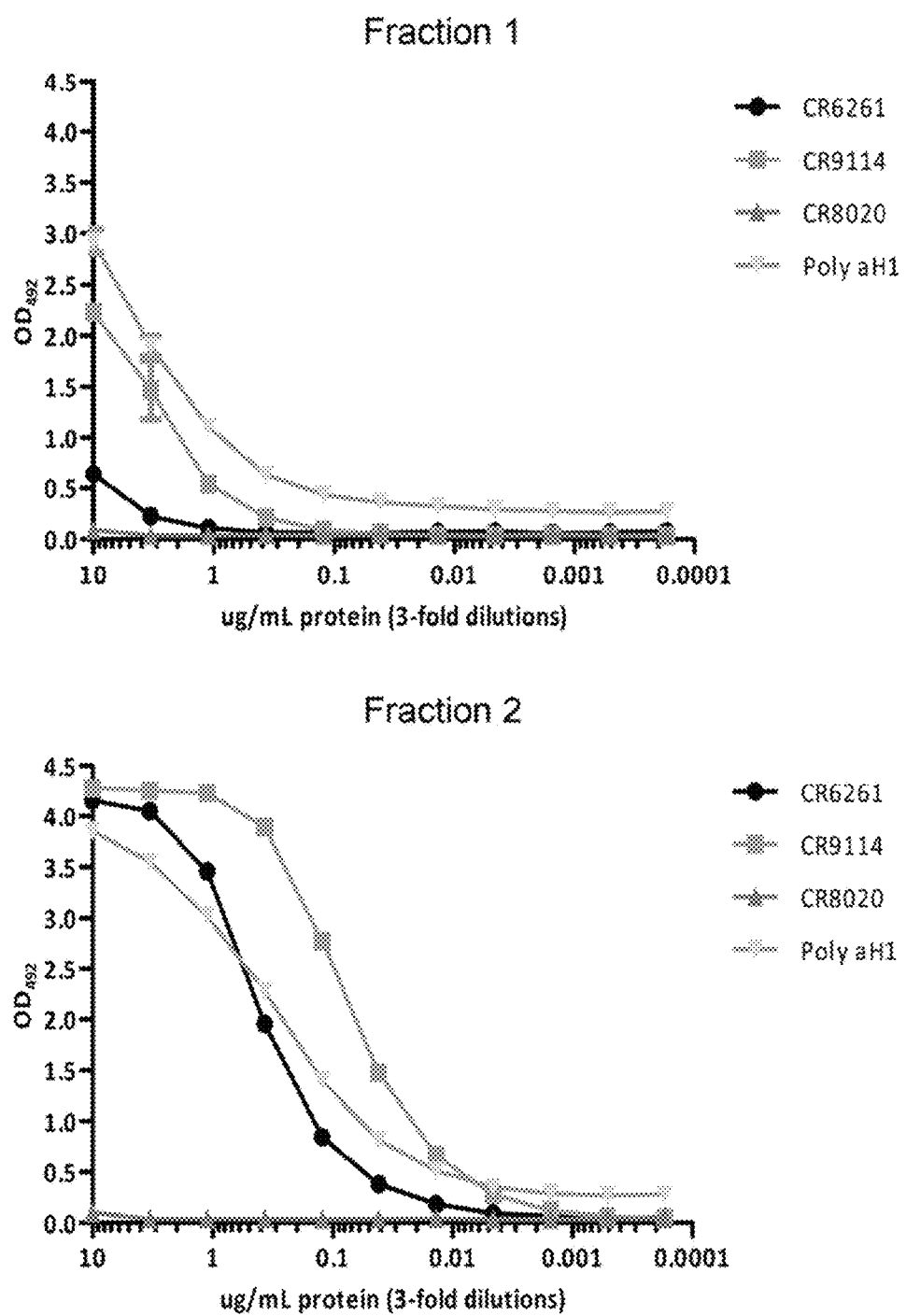

The presence of the neutralizing epitopes of CR6261, CR9114 and CR8020 was determined by ELSA, using coating of anti-His-tag monoclonal antibody to capture the his-tagged polypeptide of the invention. After binding of the mAb under study a secondary antibody conjugated to horse radish peroxidase was used for detection. As controls monomeric and trimeric full length H1 HA (antigen) as well as polyclonal serum directed against H1 HA (for detection) were included. The results are shown in FIG. 6. Binding to mAb CR6261 and CR9114 is clearly observed for fraction 2, 3 and 4, as well as for the monomeric and trimeric FL HA. For fraction 1 only a weak signal is detected for CR9114 binding, and hardly any signal for binding to CR6261. In none of the fractions binding to CR8020 (mAb specific for HA from group 2) is observed. The monomeric FL HA is recognized by the polyclonal anti-H1 HA, but the response to the trimeric FL HA is much less, possibly due to occlusion of some of the epitopes in the trimer vs the monomer. A similar pattern is observed between the results of fraction 3 (trimeric on SDS-PAGE) and fraction 4 (monomeric on SDS-PAGE), in agreement with the presence in fraction 3 of a well-folded trimeric form of the polypeptide of the invention in solution.

Figure 7:
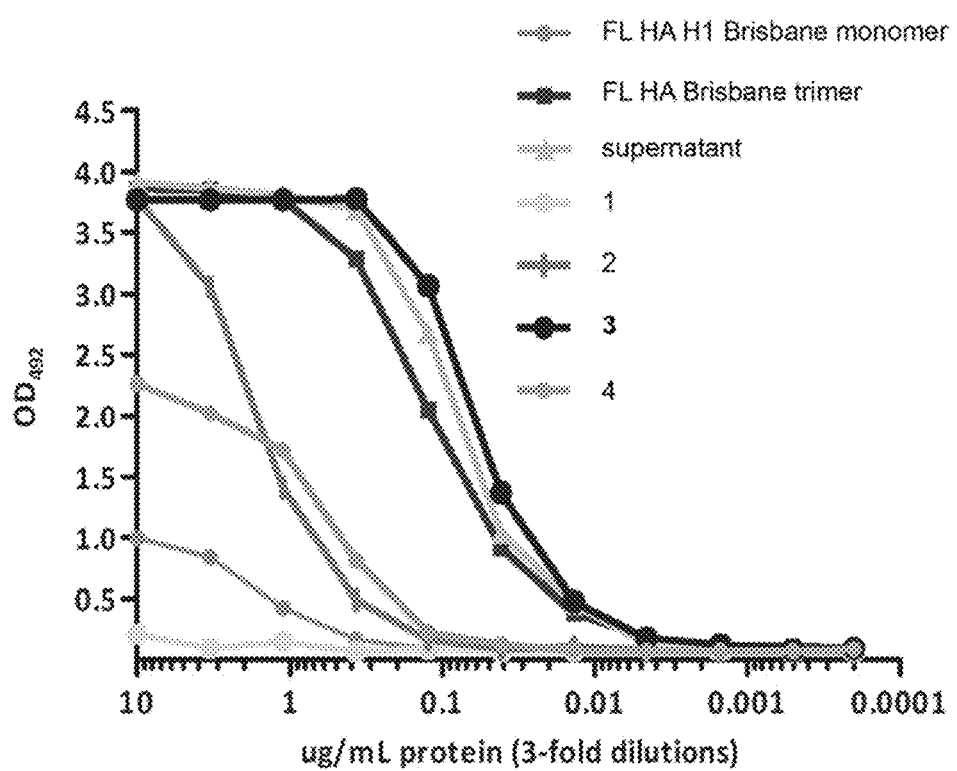

Fractions 1-4 were also tested in a CR9114 sandwich ELISA to detect multimeric polypeptides of the invention as described above (see FIG. 7). For reasons of comparison monomeric and trimeric FL HA were again included in the experiment. Fraction 3 exhibits a response very similar to the trimeric FL HA, in agreement with a trimeric form of the polypeptide of the invention, whereas the response for fraction 2 and 4 is intermediate between the monomeric and trimeric FL HA.

Figure 8:
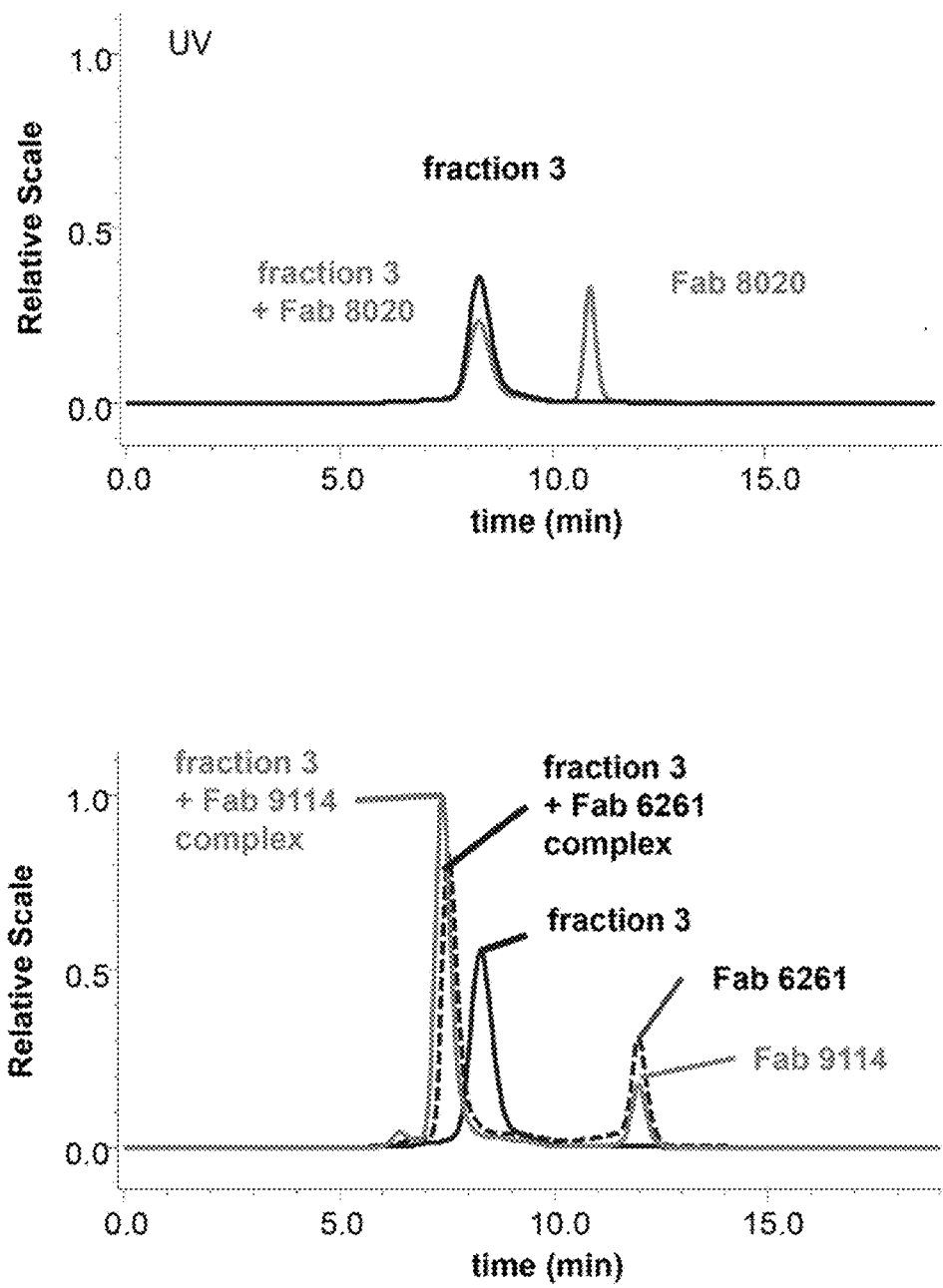

Complex formation between Fab fragments of CR6261, CR9114 and CR8020 and s127H1-t2-cl18long was studied by analytical size exclusion chromatography combined with multi-angle light scattering to estimate molecular mass (SEC-MALS) for the protein in fraction 3 (FIG. 8). The results show that the polypeptide present in fraction 3 has a molecular weight of ca. 110 kD, in line with formation of a trimer (calculated monomeric molecular weight based on amino acid sequence, excluding glycosylation is 29.2 kD). Polypeptide of the invention s127H1-t2-cl18long forms a complex (as evidenced by the shift of the peak in SEC chromatogram) in the presence of the Fab fragments from CR6261 and CR9114, but not with CR8020. This is in agreement with the specificity of the binding reactions of the Fab fragments, since CR6261 and CR9114 bind to HA's derived from group 1, whereas CR8020 does not. The size of the complex formed are ca 215 and 248 kD with Fab fragments of CR6261 and CR9114, respectively and indicate that polypeptide 127H1-t2-cl18 can bind 3 Fab fragments (the expected molecular weight for a trimer in complex with 3 Fab fragments is ca 250 kD; molecular masses as derived from the SEC-MALS experiments are summarized in table 10)

Example 5

Characterization of Polypeptides of the Invention

Figure 9:
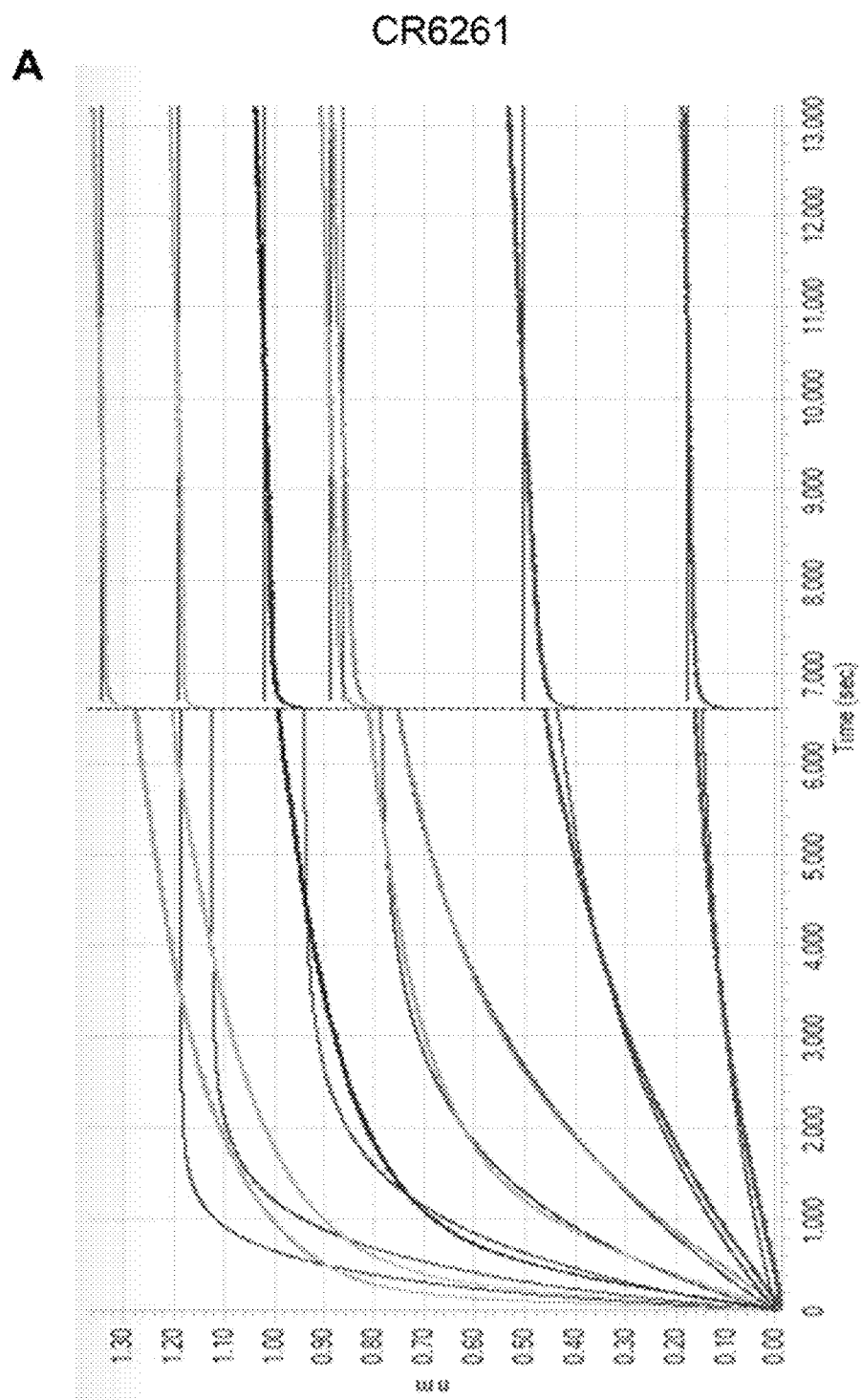
Figure 10:
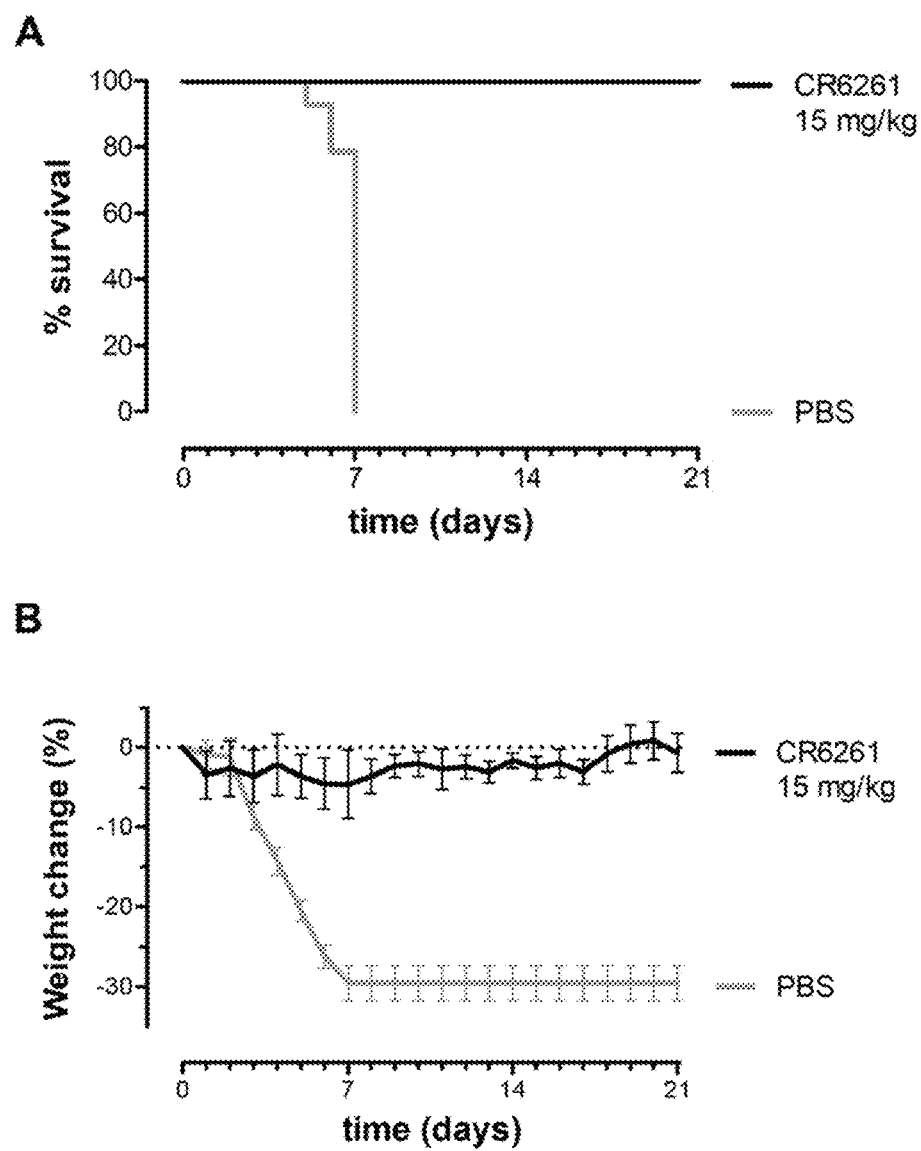
Figure 11:
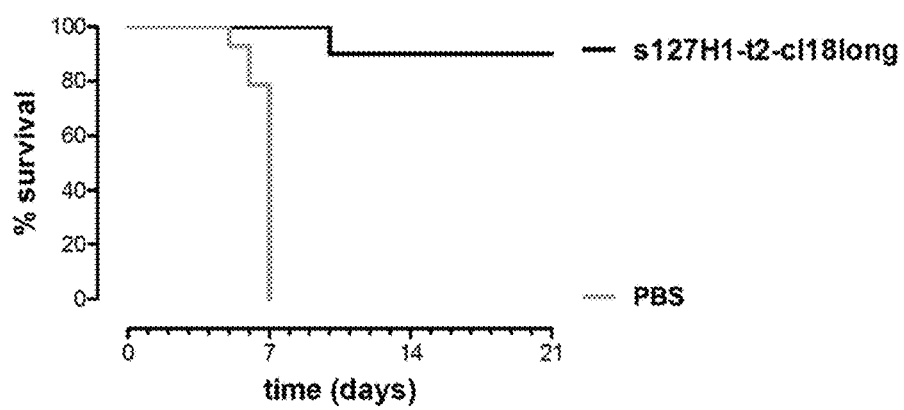
Figure 11:
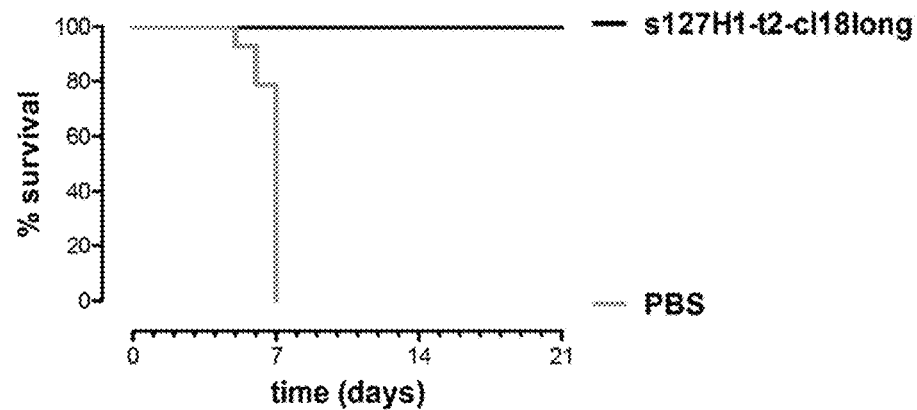
Figure 12:
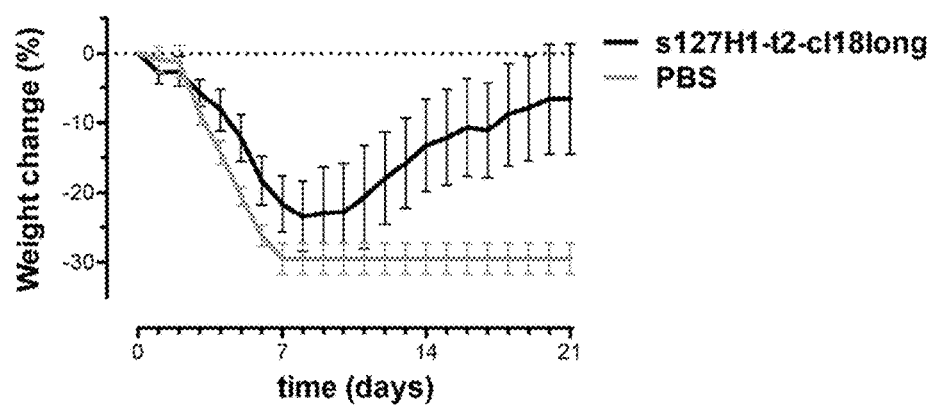
Figure 12:
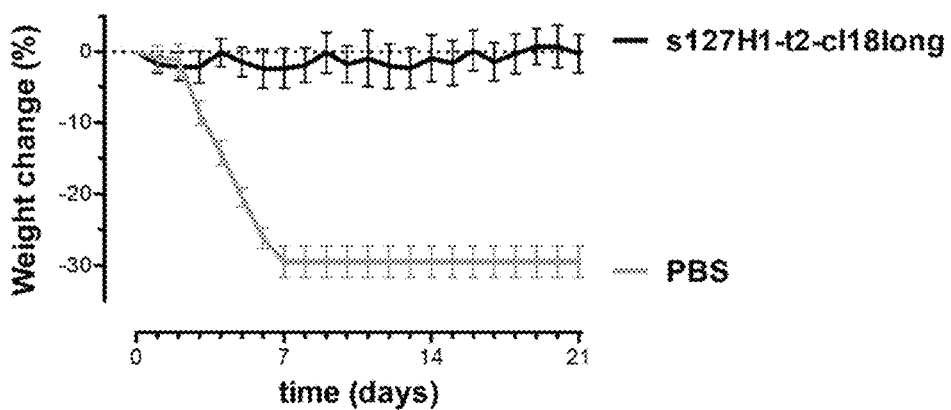

To further analyze the binding reaction between polypeptide of the invention 127H1-t2-cl18 and mAb's CR6261 and CR9114 as well as to reconfirm the presence of the conformational epitopes of CR6261 and CR9114 the complexation of these antibodies with purified protein was studied by biolayer interferometry (Octet Red[384], Forte Bio). To this end, biotinylated CR6261, CR9114 and CR8020 were immobilized on streptavidin coated sensors, which subsequently were exposed first to a solution of the purified polypeptide of the invention 127H1-t2-cl18 to measure the rate of association and then to a wash solution to measure the rate of dissociation. The results are shown in FIG. 9.

The immobilized CR6261 and CR9114 both recognize the polypeptide of the invention as evidenced by the clear responses after exposure to the soluble form of 127H1-t2-cl18 (FIGS. 9A and B). To estimate the dissociation constant for the binding interaction a titration was performed using a 2-fold dilution series. Sensors containing immobilized CR6261 or CR9114 were exposed to soluble s127H1-t2-cl18long solutions at concentrations of 10, 5, 2.5, 1.3 and 0.63, 0.31 and 0.16 nM, respectively, and the final response after 6600 seconds recorded. The responses were plotted as a function of the stem domain polypeptide concentration, and a fit to a steady state binding model was performed, yielding a dissociation constant $K_d$ of 0.7 nM for the CR6261/stem domain polypeptide complex and 0.5 nM for the CR9114 complex (FIGS. 9C and D).

In conclusion polypeptide of the invention 127H1-t2-cl18 forms a covalent trimer that is capable of binding broadly neutralizing monoclonal antibodies CR6261 and CR9114 with high avidity, confirming the presence of the corresponding neutralizing epitopes in this stem domain polypeptide. The stoichiometry of the binding reaction in solution is 1:3, indicating that the neutralizing epitopes are present in each individual monomer of the trimer.

Example 6

Figure 22:
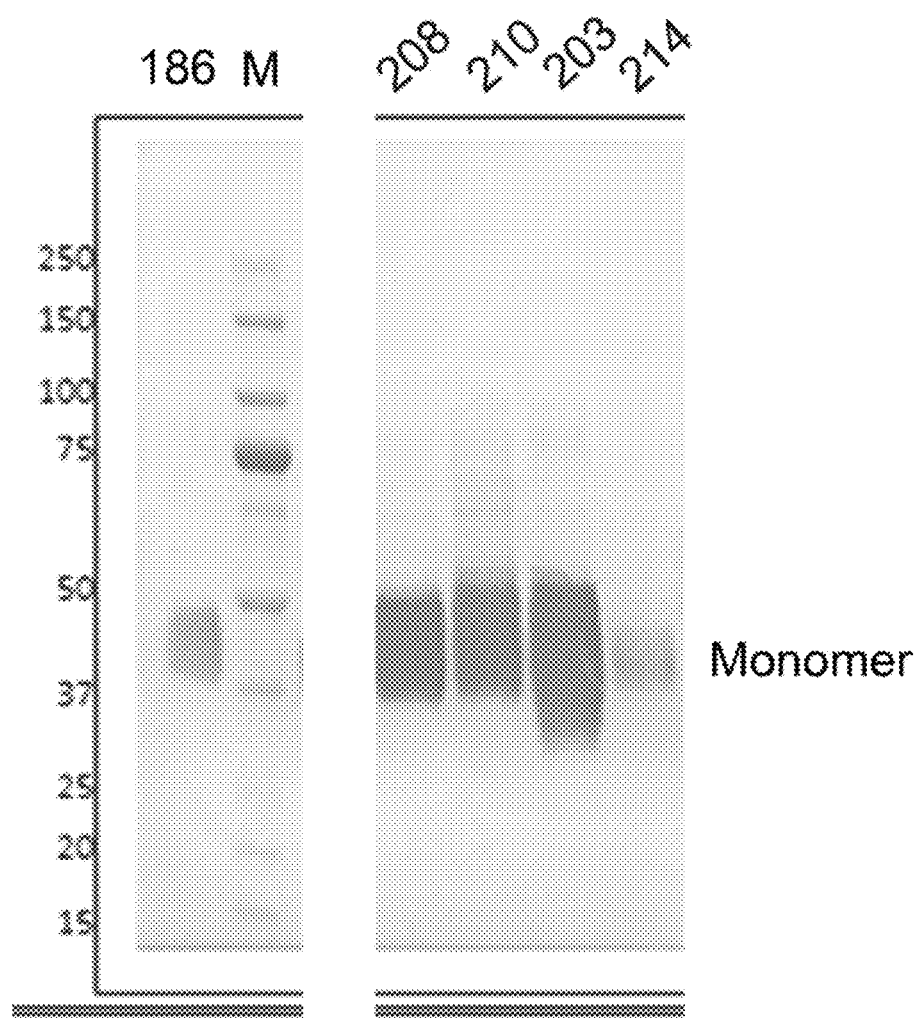
Figure 23:
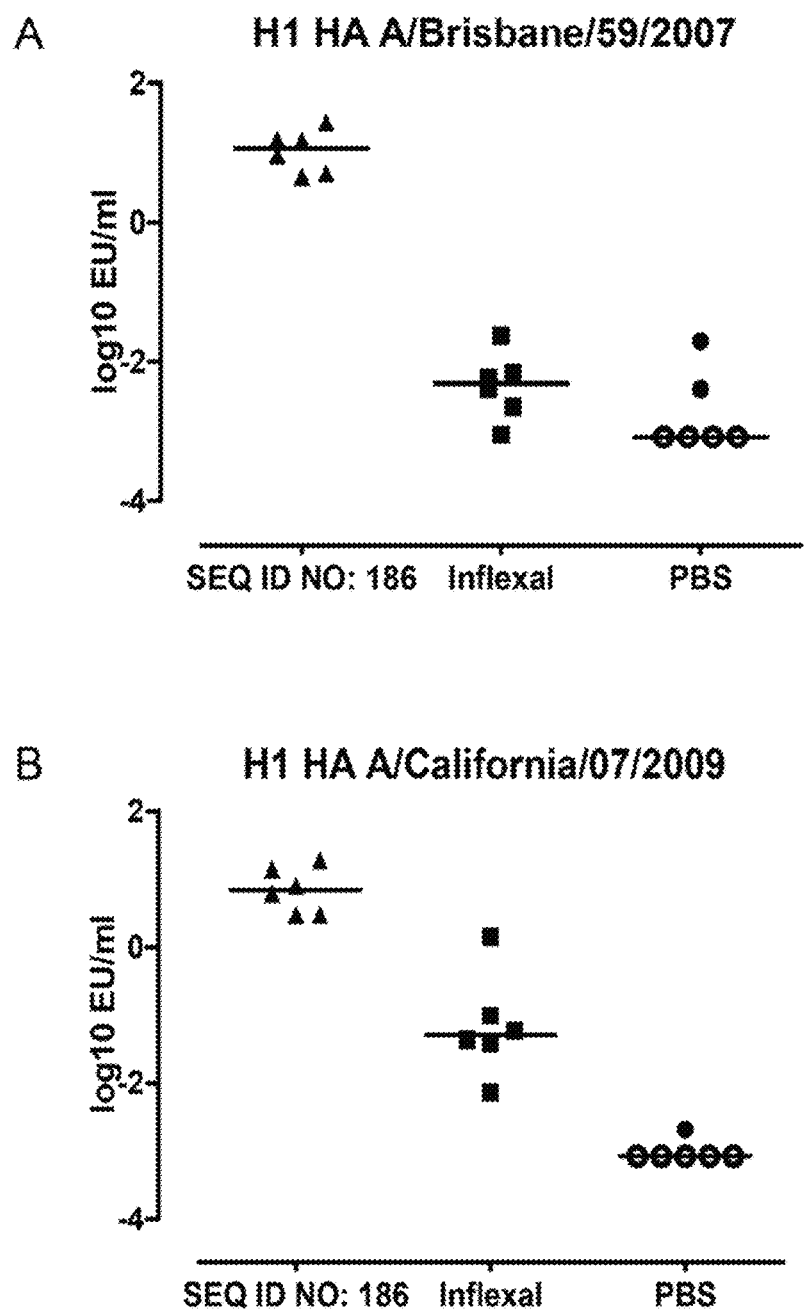
Figure 24:
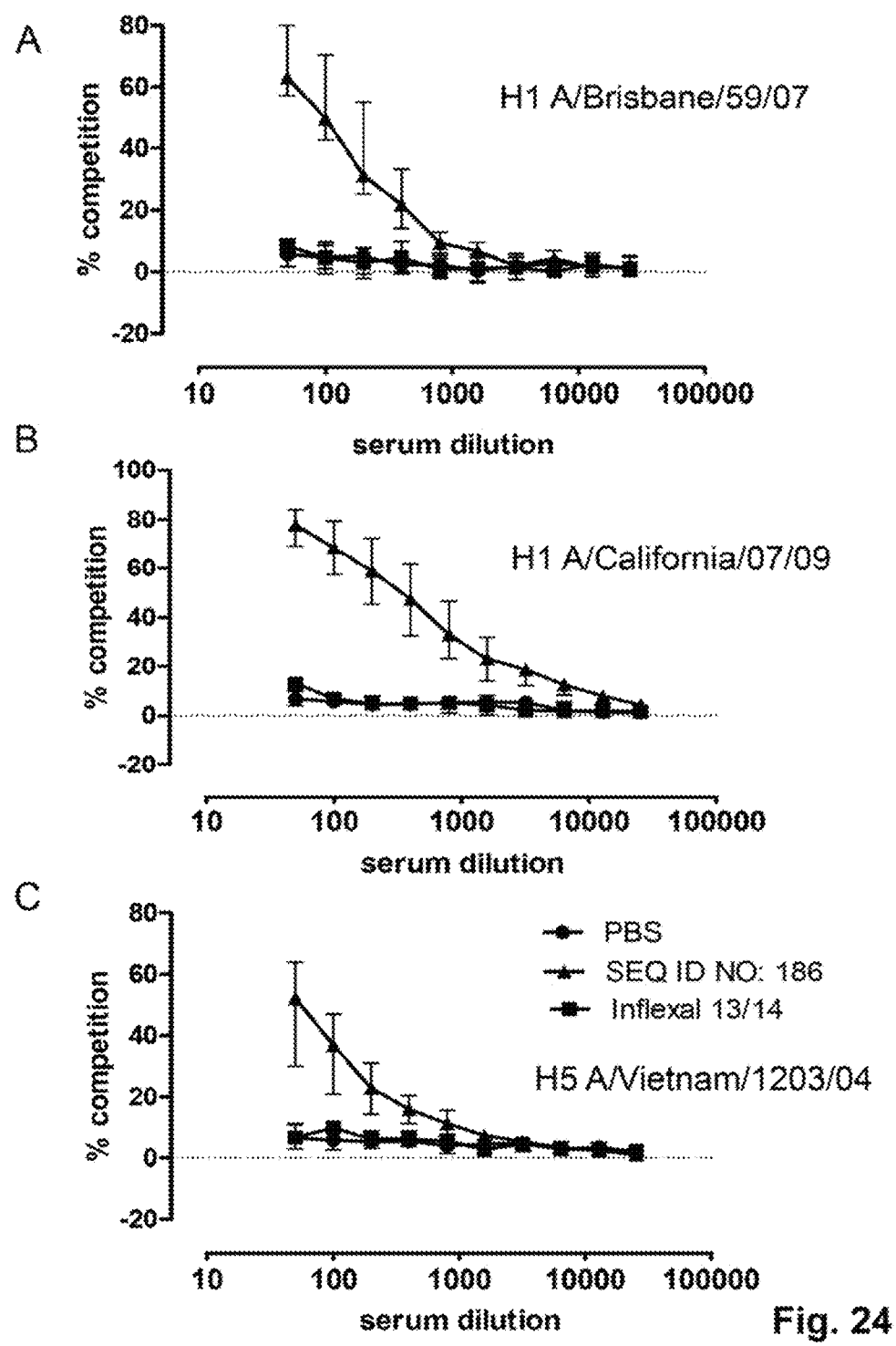
Figure 25:
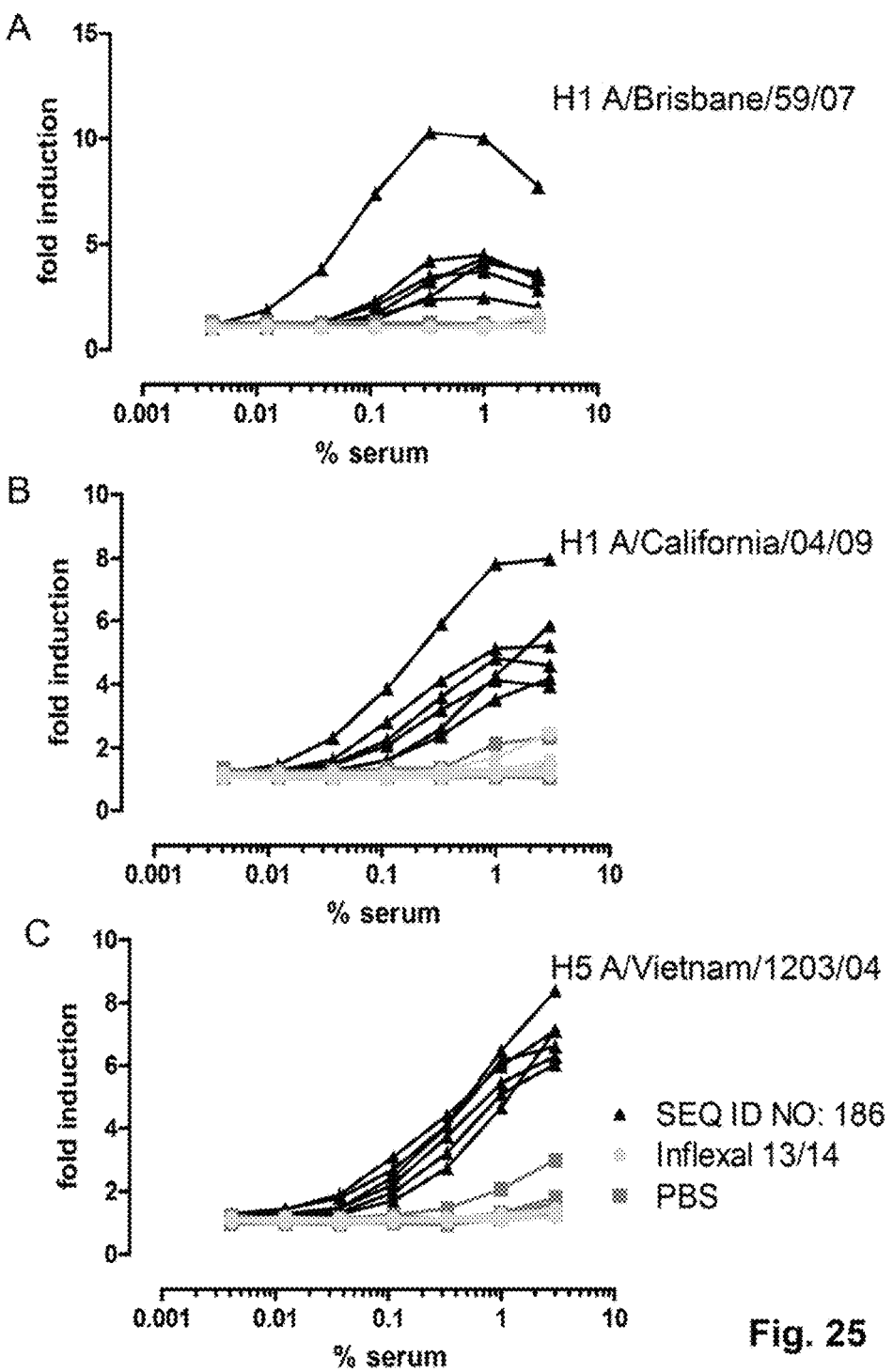
Figure 26:
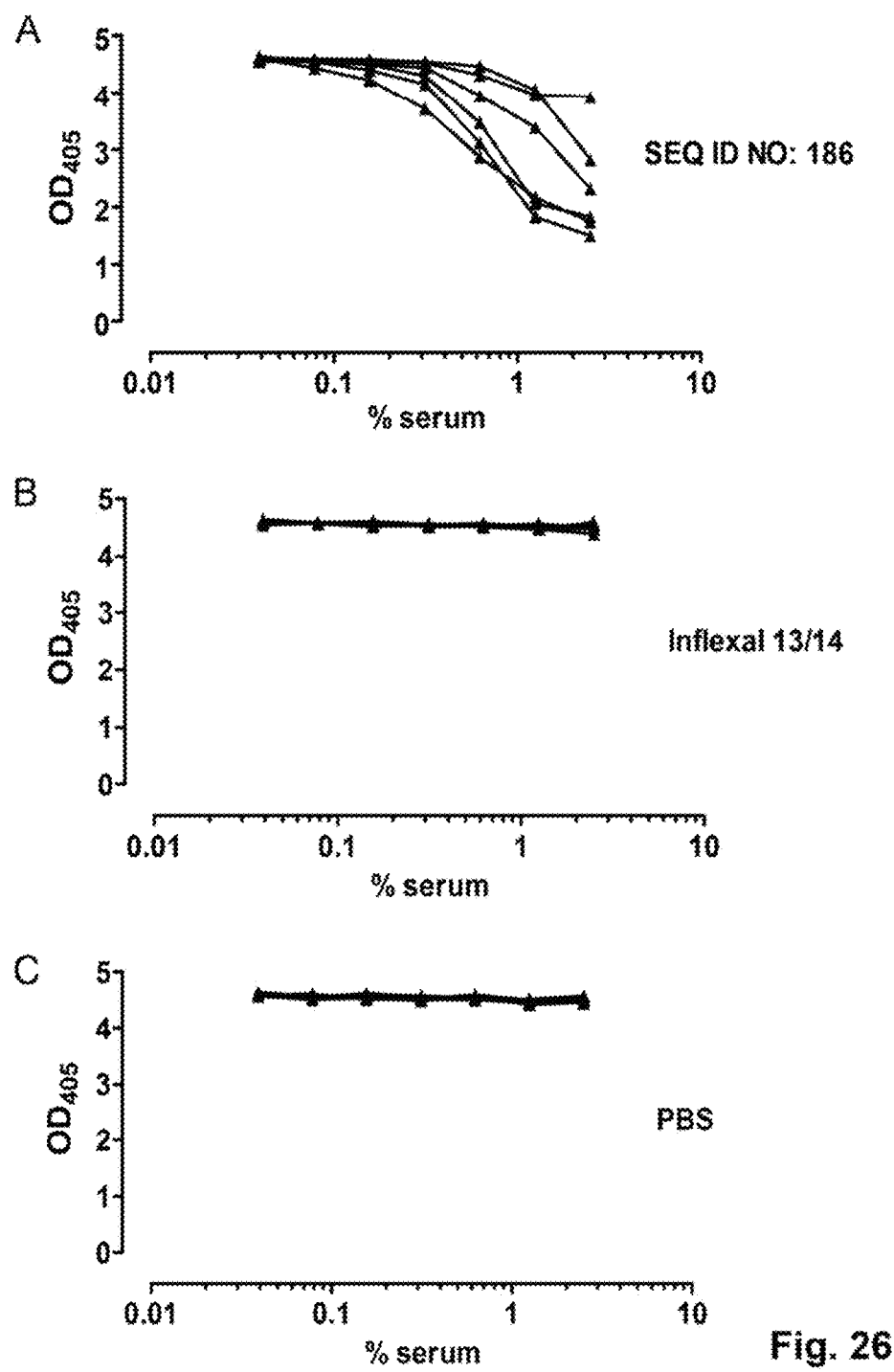
Figure 27:
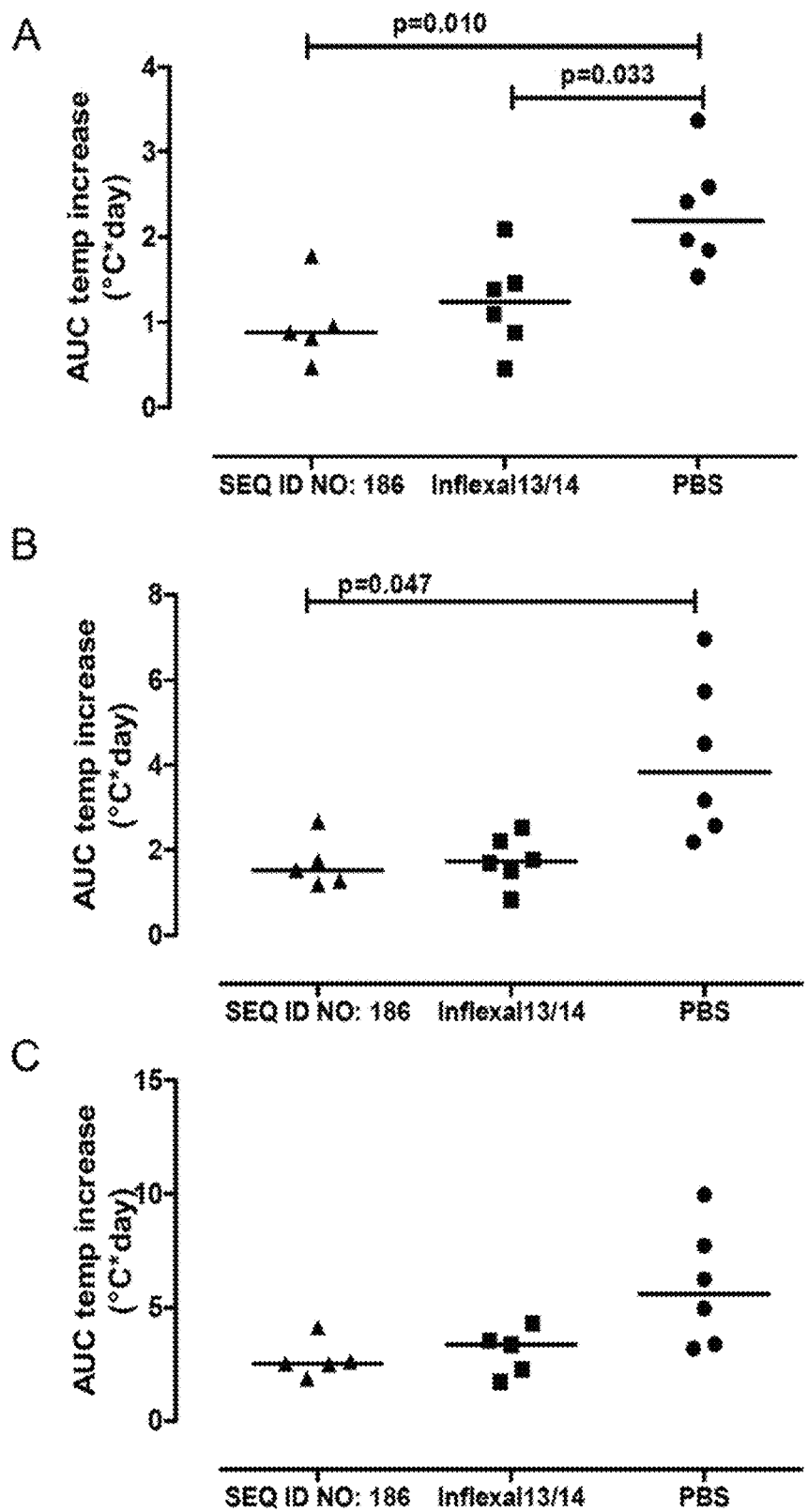

Evaluation of Protective Efficacy of a Polypeptide of the Invention in a Lethal Influenza Challenge Model In order to further evaluate the protective efficacy of polypeptides of the invention s127H1-t2-cl18long (SEQ ID NO: 186) in a lethal influenza challenge model, groups of 8-14 female BALB/c mice (age 6-8 weeks) were immunized 1, 2 and 3 times at 3 week intervals with 30 μg of purified s127H1-t2-cl18long adjuvated with 10 μg Matrix-M. As a positive control for the challenge model, broadly neutralizing antibody monoclonal antibody CR6261 (15 mg/kg) was administered i.v. 1 day prior to challenge, while immunization with PBS served as a negative control. Four weeks after the last immunization mice were challenged with 25×LD50 heterologous challenge virus (H1N1 A/Puerto Rico/8/34) and monitored daily (survival, weight, clinical scores) for 3 weeks. Pre-challenge serum (obtained 4 weeks after final immunization) was tested in ELISA assays for binding to polypeptide of the invention s127H1-t2-cl18long that was used for immunization (to verify correct immunization), binding to soluble H1N1 A/Brisbane/59/07 full length HA (to verify recognition of full length HA) and competition with the broadly neutralizing antibody monoclonal antibody CR9114 for binding to full length HA (to determine whether induced antibodies bind at close proximity to the broadly neutralizing CR9114 epitope). The results are shown in FIGS. 10-15.

The results show that the experiment is valid since all mice in the PBS control group succumb to infection at day 7 post challenge, whereas the positive control group (15 mg/kg CR6261, 1 day before challenge) is fully protected (FIG. 10A). Nine out of mice immunized once with s127H1-t2-cl18long (SEQ ID NO: 186) survived the lethal challenge, and all mice survived after two or three immunizations (FIG. 11). In addition, bodyweight loss was negligible for animals that were immunized two or three times (FIG. 12), and no (2 or 3 times) or minimal (1 time) clinical signs were observed (FIG. 13). Compared to the PBS control group, a statistical significant increased survival proportion, increased survival time, a decrease of body weight loss and reduced clinical scores were observed for all groups immunized with polypeptide of the invention s127H1-t2-cl18long The ELISA data from pre-challenge timepoints 4 week after the final immunization using s127H1-t2-cl18long (FIG. 14A) or the soluble full length HA (FIG. 14B) as the antigen indicate that the polypeptide of the invention s127H1-t2-cl18long is immunogenic and induces antibodies that are capable of recognizing full length HA even after one immunization, although levels are substantially higher after two and three immunizations.

To further understand the immunological response to the immunization a competition binding ELISA was performed. To this end plate bound full length HA was incubated with serial diluted serum samples, after which CR9114-biotin at a predetermined titrated concentration was added. After further incubation, the amount of CR9114-biotin bound was quantified using streptavin-conjugated horse radish peroxidase following protocols well known in the art. Data were analysed using robust linear regression of OD versus log dilution, expressed as 'slope OD' (ΔOD/10 fold dilution). The data show that levels of antibodies that are capable of competing for binding with the broadly neutralizing antibody CR9114 are induced by immunization with adjuvated polypeptides of the invention. After two immunizations the levels are clearly above background, and they continue to rise after the third immunization (FIG. 15, top). As a comparison levels induced by unlabeled CR9114 (i.e. self-competition) and the non-binding monoclonal antibodies CR8020, both serially diluted from 5 μg/ml starting concentration are indicated in a separate graph (FIG. 15, bottom).

In conclusion we have shown that immunization with polypeptide of the invention s127H1-t2l18long (SEQ ID NO: 186) can protect mice against lethal infection with influenza, even after a single immunization round. The polypeptide is immunogenic and induces antibodies that can bind to full length HA. At least part of the induced antibodies bind at, or close to, the epitope of the broadly neutralizing epitope of monoclonal antibody CR9114.

Example 7

Evaluation of Protective Efficacy of a Polypeptide of the Invention in a Lethal Heterosubtypic H5N1 Influenza Challenge Model In order to further evaluate the protective efficacy of polypeptides of the invention s127H1-t2-cl18long (SEQ ID NO: 186) in a lethal H5N1 influenza challenge model, groups of 8-12 female BALB/c mice (age 6-8 weeks) were immunized 3 times at 3 week intervals with 30 μg of purified s127H1-t2-cl18long adjuvated with 10 μg Matrix-M. As a positive control for the challenge model, broadly neutralizing antibody monoclonal antibody CR6261 (15 mg/kg) was administered i.v. I day prior to challenge, while immunization with PBS served as a negative control. Four weeks after the last immunization mice were challenged with 12.5×LD50 heterosubtypic challenge virus (H5N1 A/Hong Kong/156/97) and monitored daily (survival, weight, clinical scores) for 3 weeks. The results are shown in FIG. 16.

The results show that the experiment is valid since all mice in the PBS control group succumb to infection between day 8-10 post challenge, whereas the positive control group (15 mg/kg CR6261, 1 day before challenge) is fully protected (FIG. 16A). Ten out of 10 mice immunized with s127H1-t2-cl18long (SEQ ID NO: 186) survive the lethal challenge (FIG. 16B). In addition bodyweight loss is negligible for these animals (FIG. 16C) and no clinical symptoms were observed during the follow-up period (FIG. 16D). Compared to the PBS control group, a statistical significant increased survival proportion, increased survival time, a decrease of body weight loss and reduced clinical scores are observed for the group immunized with polypeptide of the invention s127H1-t2-cl18long.

In conclusion we have shown that immunization with polypeptide of the invention s127H1-t2l18long (SEQ ID NO: 186) can protect mice against lethal infection with a heterosubtypic H5N1 influenza strain.

Example 8

Evaluation of the Breadth of Binding of Sera Elicited Through Immunization with a Polypeptide of the Invention The results described in Example 6 indicate that polypeptide of the invention s127H1-t2-cl18long (SEQ ID NO: 186)

is immunogenic and can elicit antibodies that are capable of recognizing FL HA from the strain used as the basis for design of polypeptides of the invention. Sera from mice immunized 3 times as described in example 7 were also tested for binding against full length HA's from a number of other group 1 (H1, H5 and H9) and group II (H3 and H7) influenza strains by ELISA following protocols well known in the art (FIG. 17). The results demonstrate that antibodies induced with polypeptide of the invention s127H1-t2-cl18long (SEQ ID NO: 186) efficiently recognize epitopes present in the native sequences of FL HA and that the epitopes to which the antibodies bind are conserved among different group 1 (in particular H1, H5 and H9) and even some group 2 influenza strains (e.g. H7).

Example 9

Evaluation of Protective Efficacy of a Polypeptide of the Invention in a Lethal H1N1 A/Brisbane/59/2007 Influenza Challenge Model In order to further evaluate the protective efficacy of polypeptides of the invention s127H1-t2-cl18long (SEQ ID NO: 186) in a lethal H1N1 influenza challenge model, groups of 8-18 female BALB/c mice (age 6-8 weeks) were immunized 3 times at 3 week intervals with 30 μg of purified s127H1-t2-cl18long adjuvated with 10 μg Matrix-M. As a positive control for the challenge model, broadly neutralizing antibody monoclonal antibody CR6261 (15 mg/kg) was administered i.v. 1 day prior to challenge, while immunization with PBS served as a negative control. Four weeks after the last immunization mice were challenged with 12.5× LD50 challenge virus (H1N1 A/Brisbane/59/2007) and monitored daily (survival, weight, clinical scores) for 3 weeks.

The results show that the experiment is valid since all mice in the PBS control group succumb to infection between day 7-10 post challenge, whereas the positive control group (15 mg/kg CR6261, 1 day before challenge) is fully protected (FIG. 18A). Ten out of 10 mice immunized with s127H1-t2-cl18long (SEQ ID NO: 186) survive the lethal challenge (FIG. 18B). In addition bodyweight loss is ca 10% on average 4 days post infection (FIG. 18C), but animals recover fully within 10 days. Clinical symptoms also peak at 4 days post infection but are absent from day 9 post infection onwards (FIG. 18D). Compared to the PBS control group, a statistical significant increased survival proportion, increased survival time, a decrease of body weight loss and reduced clinical scores are observed for the group immunized with polypeptide of the invention s127H1-t2-cl18long In conclusion we have shown that immunization with polypeptide of the invention s127H1-t2l18long (SEQ ID NO: 186) can protect mice against lethal infection with H1N1 A/Brisbane/59/2007.

Example 10

Evaluation of the Presence of Influenza Neutralizing Antibodies in Sera of Mice Immunized with the Polypeptide of the Invention To further investigate antibody-mediated effector mechanisms that play a role in protection against influenza, pre-challenge sera were tested in pseudoparticles neutralization assay (Alberini et al 2009) using the pseudoparticles derived from H5N1 A/Vietnam/1194/04 as described below.

Pseudoparticle Neutralization Assay

Pseudoparticles expressing FL HA were generated as previously described (Temperton et al., 2007). Neutralizing antibodies were determined using a single transduction round of HEK293 cells with H5 A/Vietnam/1194/04 pseudoparticles encoding luciferase reporter gene, as described previously (Alberini et al 2009), with a few modifications. Briefly, heat-inactivated (30 minutes at 56° C.) pre-challenge serum samples were 3-fold serially diluted in growth medium (MEM Eagle with EBSS (Lonza, Basel, Switzerland) supplemented with 2 mM L-Glutamine (Lonza), 1% Non-Essential Amino Acid Solution (Lonza), 100 U/ml Pen/Strep (Lonza) and 10% FBS (Euroclone, Pero, Italy)) in triplicate in 96-well flat bottom culture plates and a titrated number of H5 A/Vietnam/1194/04 pseudoparticles (yielding $10^6$ Relative Luminescence Units (RLU) post-infection) was added. After 1 h incubation at 37° C., 5% $CO_2$ $10^4$ HEK293 cells were added per well. After 48 h incubation at 37° C., 5% $CO_2$ luciferase substrate (Britelie Plus, Perkin Elmer, Waltham, Mass.) was added and luminescence measured using a luminometer (Mithras LB 940, Berthold Technologies, Germany) according to manufacturers' instructions.

Pre challenge sera obtained from animals immunized with polypeptide of the invention s127H1-t2l18long (SEQ ID NO: 186) as described in examples 6, 7 and 8 showed detectable neutralization at high serum concentrations using the pseudoparticle neutralization assay (FIG. 19). This demonstrates the ability of the polypeptide of the invention to elicit broadly neutralizing antibodies when used as an immunogen. Besides direct virus neutralization, Fc-mediated effector mechanisms, such as Antibody Dependent Cellular Cytotoxicity (ADCC) and Antibody Dependent Cellular Phagocytosis (ADCP), contribute substantially to protection against influenza, with stem-directed bnAbs being particularly effective in these mechanisms (DiLillo et al. 2014) In order to test whether the antibodies elicited after immunization with polypeptide of the invention s127H1-t2l18long (SEQ ID NO: 186) were capable of inducing ADCC, we tested pre-challenge sera using an ADCC surrogate assay (Parekh et al., 2012; A. Schnueriger et al., 2012; Cheng et al 2014) adapted for mouse as described below.

Antibody Dependent Cellular Cytotoxicity (ADCC) Surrogate Assay

Human lung carcinoma-derived A549 epithelial cells (ATCC CCL-185) were maintained in Dulbecco's modified eagle medium (DMEM) medium supplemented with 10% heat inactivated fetal calf serum at 37° C., 10% CO2. Two days before the experiment, A549 cells were transfected with plasmid DNA encoding H5 A/Hong Kong/156/97 H-A or H1 A/Brisbane/59/2007 HA using Lipofectamine 2000 (Invitrogen) in Opti-MEM (Invitrogen). One day before the assay, transfected cells were harvested and seeded in white 96-well plates (Costar) for ADCC, and black clear bottom 96-well plate (BD Falcon) for imaging. After 24 hours, samples were diluted in assay buffer (4% ultra-low IgG FBS (Gibco) in RPMI 1640 (Gibco)) and heat inactivated for 30 minutes at 56° C., followed by serial dilution in assay buffer. For the ADCC bioassay, A549 cells were replenished with fresh assay buffer and antibody dilutions and ADCC Bioassay Jurkat effector cells expressing mouse Fc gamma receptor IV (FcγRIV; Promega) were added to the cells and incubated for 6 hours at 37° C. at a target-effector ratio of 1:4.5. Cells were equilibrated to room temperature for 15 min before Bio-Glo Luciferase System substrate (Promega) was added. Luminescence was read out after 10 minutes on a Synergy Neo (Biotek). Data are expressed as fold induction of signal in the absence of serum.

Using this assay pre-challenge sera obtained from animals immunized with polypeptide of the invention s127H1-t2l18long (SEQ ID NO: 186) as described in examples 6, 7 and 8 were tested for FcγRIV signaling activity using target cells transfected with FL HA from H5N1 A/Hong Kong/156/97 or H1N1 A/Brisbane/59/07 as the source of antigen (FIG. 20). In both cases a 30 to 40 fold induction at highest serum concentration tested is observed demonstrating the ability of the polypeptide of the invention to elicit antibodies that activate FcγRIV signaling, indicative for ADCC/ADCP effector function in mice.

These results shown in examples 6-9 show the capability of polypeptide of the invention s127H1-t2l18long (SEQ ID NO: 186) is able to elicit stem-targeting, neutralizing and ADCC-mediating antibodies and protect mice against a lethal challenge with homologous, heterologous and hetero-subtypic group I influenza strains.

Example 11

Design of a Polypeptide of the Invention of Based on the HA from H1N1 A/California/07/09

Examples 1 to 10 describe polypeptides of the invention based on the HA from H1N1 A/Brisbane/59/2007. Similar polypeptides can also be designed based on other HA from other influenza strains such as H1N1 A/California/07/09. So following the procedures outlined above the polypeptides of the invention described in SEQ ID NO: 202 and 203 were created.

Example 12

Design of Further Polypeptides of the Invention Based on the HA from H1 Strains Examples 1 to 11 describe polypeptides of the invention based on the HA from H1N1 A/Brisbane/59/2007 (SEQ ID NO: 1) and H1N1 A/California/07/09 (SEQ ID NO: 252). Similar polypeptides can also be designed based on HA from other H1 influenza strains, and these are also included in the invention. Non-limiting examples are the HA's of H1N1 A/Texas/UR06-0526/07 (SEQ ID NO: 205), H1N1 A/New York/629/95 (SEQ ID NO: 206) and H1N1 A/AA_Marton/43 (SEQ ID NO: 204). So following the procedures outlined above stem domain polypeptides of the invention containing engineered disulfide bridges between cysteines at position 411 and 419 (cluster 18) described in SEQ ID NO: 207 to 216 were created. SEQ ID NO: 202, 203, 213 and 214 contain an additional lysine mutation introduced at position 415 (numbering refers to SEQ ID NO: 1) to create a B-loop sequence according to SEQ ID NO: 8; these sequences are also included in the invention.

Example 13

Expression and Characterization of Polypeptides of the Invention

To test for the presence of the designed disulfide bridges and the neutralizing epitopes of CR9114 and CR6261, soluble forms of the designed polypeptides were expressed in HEK293F cells. Soluble forms were created by deleting the equivalent of amino acid residues 530-565 (numbering refers to SEQ ID NO: 1) from SEQ ID NO: 202, 207, 209, 213, to create polypeptides of the invention SEQ ID NO: 203, 208, 210 and 214, respectively. It is noted that these sequences describe the processed form of the polypeptides, ie, after removal of the leader sequence. An additional sequence EGRHHHHHHH (SEQ ID NO: 19) or in the case of SEQ ID NO: 208 EGRHHHHHH was added at the C-terminus, in effect introducing a 7 or 6 histidine purification tag preceded by a Factor X proteolytic cleavage site to aid with purification and/or detection.

To produce the polypeptides $1.0*10^6$ vc/mL were seeded by spinning down HEK293F cells (Invitrogen) at 300 g for 5 min and resuspending in 30 mL pre-warmed Freestyle™ medium per SF250 flask. This culture was incubated for 1 hour at 37° C., 10% CO2 at 110 rpm in a multitron incubator. After 1 hour the plasmid DNA was pipetted in 1 mL Optimem medium to a concentration of 1.0 μg/mL in the 30 mL culture volume. In parallel 44 μL 293Fectin® was pipetted in 1 mL Optimem medium and incubated for 5 minutes at room temperature. After 5 minutes the plasmid DNA/Optimem mix was added to the 293Fectin®/Optimem mix and incubated at room temperature for 20 minutes. After the incubation the plasmid DNA/293Fectin® mix was added drop wise to the cell suspension. The transfected cultured was incubated at 37° C., 10% CO2 and 110 rpm in a multitron incubator. At day 7 cells were separated from the culture medium by centrifugation (30 minutes at 3000 g), while the supernatant containing the soluble polypeptides of the invention was filtrated over a 0.2 μm bottle top filter for further processing.

Culture medium was collected and was analyzed in a sandwich ELISA for the presence of multimeric forms of polypeptides that present two or more epitopes of the broadly neutralizing antibody CR9114. First, CR9114 coated plates were used to capture the expressed polypeptides directly from the culture medium. Second, biotinylated CR9114 in combination with HRP-conjugated streptavidin was used for detection of CR9114 captured polypeptides of the invention. For reasons of comparison soluble purified full length HA from H1N1 A/Brisbane/59/2007 in trimeric and monomeric form as well as purified trimeric s127H1-t2-cl18long (SEQ ID NO: 186) was included in the assay (starting concentration 5 μg/ml). The results are shown in FIG. 21A.

The trimeric full length HA shows a clear signal at low dilution, but at a dilution of 1 in 6561 or higher (i.e. lower concentration) this signal is no longer detectable (FIG. 21A). For the monomeric full length HA a signal is also observed at low dilution but intensity is much lower and the signal is no longer detectable at a dilution of 1 in 729. Most likely the signal is caused by some residual trimer that could not be separated from monomer during purification or has formed from the monomer over time. Purified trimeric s127H1-t2-cl18long (SEQ ID NO: 186) containing an additional C-terminal his tag sequence (EGRHHHHHHH), (starting concentration 5 μg/ml) also results in a clear signal in this assay which becomes undetectable at a concentration of 1 in 19683. The culture media containing polypeptides of the invention SEQ ID NO: 203, 208, 210 and 214 also show clear signals in this assay, indicating the presence of multimeric polypeptides of the invention. The strongest responses are observed for the polypeptide derived from A/California/07/09 (SEQ ID NO: 203). The weaker response in the assay observed for the polypeptide of the invention derived from H1N1 A/AA_Marton/1943 (SEQ ID NO: 214) is a result from the lower expression of this particular polypeptide of the invention as evidenced from the results from a western blot of the culture media described below.

To further characterize the polypeptides of the invention containing additional cysteines, the culture supernatants were analysed by Western Blot using protocols well established in the art. For detection purposes a polyclonal antibody directed against the HA-protein of H1N1 (A/California/04/2009) was used. For a disulfide linked trimer under non-reducing conditions, i.e. when disulfide bridges are intact, a protein band at ~90 kDa or above (depending on extent of glycosylation) is expected, whereas under reducing conditions a band close to 35 kD (corresponding to the glycosylated monomeric polypeptide of the invention) is expected. FIG. 22 shows the results for the polypeptides of the invention derived from the HA from strains H1N1 A/Texas/(SEQ ID NO: 208), H1N1 A/New York/629/95 (SEQ ID NO: 210), H1N1 A/California/07/09 (SEQ ID NO: 203) and H1N1 A/AA_Marton/1943 (SEQ ID NO: 214). The Western Blot under reducing conditions shows that all four polypeptides of the invention express, albeit to different levels, with the highest expression observed for H1N1 A/California/07/09 derived polypeptide of the invention (SEQ ID NO: 203) and the lowest for H1N1 A/AA_Marton/1943 derived polypeptide (SEQ ID NO: 214). Under these conditions the polypeptides run as monomers in the gel similar to the purified trimeric s127H1-t2-cl18long (SEQ ID NO: 186) containing an additional C-terminal his tag sequence (EGRHHHHHHH). Under non-reducing conditions a band between 100 and 150 kD, indicative of the presence of trimeric polypeptide of the invention is observed for all polypeptides of the invention (including s127H1-t2-cl18long (SEQ ID NO: 186)). For the polypeptide derived from H1N1 A/AA_Marton/1943 (SEQ ID NO: 214) the monomeric band is no longer visible, and a band at the expected height for a trimer appears, albeit at low intensity due to the lower expression of this polypeptide. In addition, dimeric forms running at about 75 kD can also be observed. The polypeptides of the invention are somewhat heterogeneous in size due to variation in the extent of glycosylation of individual polypeptides of the invention.

To further confirm the presence of the neutralizing epitopes of CR6261 and CR9114 culture supernatants were analyzed by ELISA. First, plates coated with an antibody directed to the his-tag on the soluble polypeptides of the invention were used to capture the expressed polypeptides directly from the culture medium. Second, CR9114 or CR6261 were added and HRP-conjugated goat anti-human antibody was used for detection of CR9114 or CR6261 binding to polypeptides of the invention. As a positive control soluble purified full length HA from H1N1 A/Brisbane/59/2007 in trimeric and monomeric form were included in the assay (FIG. 21B, C). As a negative control an ELISA using mAb CR8020, specific for HA from group 2, was also performed. The results are shown in FIG. 21D. The polypeptides of the invention show clear response in the ELISA's with CR9114 and CR6261, with the highest response observed for the polypeptide derived from A/California/07/09 (SEQ ID NO: 203). Purified soluble full length HA (both monomeric and trimeric) also show strong responses. As expected, no response was observed in the ELISA with CR8020, confirming the specificity of the binding of CR6261 and CR9114 to the polypeptides of the invention.

In conclusion the results above show that polypeptides of the invention derived form H1 HA sequences as described above can form trimeric species and contain the neutralizing epitopes of CR6261 and CR9114.

Example 14

Design of Further Polypeptides of the Invention Based on the HA from Influenza Group 1 Strains Examples 1 to 13 describe polypeptides of the invention based on the HA from H1N1. Similar polypeptides can also be designed based on HA from other group 1 influenza strains, for example those containing H2, H5 and H9 HA. These polypeptides are also included in the invention. Non-limiting examples of such strains are for example H2N2 A/Adachi/2/1957, H2N2 A/Singapore/1/1957, H5N1 A/Vietnam/1203/2004 and H9N2 A/Hong Kong/69955/2008. So following the procedures outlined above the polypeptides of the invention containing engineered disulfide bridges between cysteines at position 411 and 419 (cluster 18) described in SEQ ID NO: 218 to 221, SEQ ID NO: 223 to 226, SEQ ID NO: 228 to 231, and SEQ ID NO: 233 to 236 were created.

It should be noted that the full length HA from H5N1 A/Vietnam/1203/2004 (SEQ ID NO: 227) contains a polybasic cleavage site, i.e. sequence RRRKTR at position 341-346 in SEQ ID NO: 227 directly preceding the fusion peptide sequence. In polypeptides of the invention 228-231 the polybasic cleavage site has been removed and replaced by a single glutamine (Q) residue to remove the complete cleavage site. These sequences are also encompassed in the invention.

SEQ ID NO: 219, 221, 224 and 226 contain further mutations at positions 407 and 414-416 (numbering according to SEQ ID NO: 1; please note that in the H2 sequences residues at positions 9, 10 and 139 are deleted compared to SEQ ID NO: 1) to create a B-loop sequence according to SEQ ID NO: 8 with the exception of residue 418 that is a cysteine.

SEQ ID NO: 230 and 231 contain additional mutations at positions 407 (E407T) and 415 (N415S) (numbering according to SEQ ID NO: 1). These mutations create a B-loop according to SEQ ID NO: 8 with the exception of residue 418 that is a cysteine. SEQ ID NO: 236 and 236 have been further modified to contain the sequence MNTQYTAIGC-EYNKSE (i.e a sequence according to SEQ ID NO: 8 with the exception of residue 418 that is a cysteine).

Example 15

Design of Disulfide Stabilized Trimers of the Present Invention Based on the HA from Influenza Group 2 Strains Examples 1 to 14 describe polypeptides of the invention based on the HA from group 1 strains. Disulfide cross-linked polypeptide can also be designed on the basis of HA sequences from group 2, such as for example H3 and H7. These polypeptides are also included in the invention. Non-limiting examples of such strains are for example H3N2 A/Hong Kong/1/1968 and H7.

One way to improve the presentation of neutralizing epitopes on an immunogen in a vaccine is to engineer additional interactions between monomer immunogens in order to create multimeric species with increased stability compared to the monomer. A disadvantage of this method is that by bringing together the monomeric immunogens important epitopes can potentially be covered by the next protomer. Therefore care should be taken to avoid this.

Here we describe modified polypeptides of the invention that form stable trimers in solution while exposing the epitopes of neutralizing mAb CR8020 and CR8043.

To generate a trimeric polypeptide of the invention stabilizing interactions promoting trimerization of monomeric species of HA-stem based polypeptides were designed, focusing in particular on creating covalent disulfide bridges between individual monomers in the trimer. To this end the three dimensional structure of FL HA from H3N2 A/Hong Kong//1/1968 (PDB: 3SDY) was analyzed to identify areas where the proximity of another monomer and the conformational features of the protein could potentially allow the formation of an intermonomer disulfide bridge. Six pairs of residues were identified (table 11). Care was taken to ensure that for each pair the residues were located on a different protomer (monomer) in the trimeric structure. The equivalent of these residues (as determined from sequence alignment) in stem domain polypeptides based on group 2 are then mutated into cysteine to create polypeptides of the invention so that polypeptides covalently linked through formation of disulfide bridges can be formed. Taking into account the 3-fold symmetry of the trimeric HA molecule successful designs lead to formation of three interprotomer disulfide bridges, covalently connecting each of the monomers in the trimer to the two other monomers.

WO2013/079473 describes stem domain polypeptides based on HA from group 2 strains capable of binding the broadly neutralizing antibodies CR8020, CR8043. The disulfide pairs from table 11 were introduced in polypeptide H3 HK mini2a-linker+cl9+10+11+12+GCN4T (SEQ ID NO: 238 here; SEQ ID NO: 130 in WO2013/079473) and H3 HK mini2a-linker+cl9+10+11+12+GCN4T-CG7-1 (SEQ ID NO: 239 here; SEQ ID NO: 174 in WO2013/079473), derived from the HA of H3N2 A/Hong Kong/1/1968 (SEQ ID NO: 237) to arrive at polypeptides of the invention 240 to 251.

The sequences of SEQ ID NO: 240 to 251 contain the HA leader sequence. The person skilled in the art will understand that in the mature protein the leader sequence has been cleaved off and is no longer present. The processed sequences are also included in the invention.

Soluble forms of the polypeptides of the invention can be created by deletion of the C-terminal transmembrane region and cytoplasmic domain. The deletion can for example include the residues from 525, 526, 527, 528, 529, 530, 531, 532, 533, 534, 535, 536 or 537 to the C-terminus. These polypeptides are also included in the invention. In some cases a C-terminal trimerization sequence, optionally connected through a short linker, optionally containing a proteolytic cleavage site can be added. An example of a trimerization domain is the foldon sequence of SEQ ID NO: 3. The processed sequences are also included in the invention.

Example 16

Validation of a NHP pH1N1 Challenge Model for Use in Influenza Vaccine Protective Efficacy Evaluation and Immunogenicity and Protective Efficacy of H1 Mini-HA #4900 in NHP To be able to study immunogenicity and protective efficacy of UFV vaccine candidates in an alternative model, a non-human primate (NHP) challenge model in Cynomolgus macaques (*Macaca fasicularis*) using a pandemic H1N1 strain (A/Mexico/InDRE4487/2009) has previously been established at BPRC (Rijswijk, The Netherlands). This model is based on a model published in literature by Safronetz et al (2011) *J Virol*, 85:1214 However, it needed to be established whether the model could be used for evaluation of protective efficacy of influenza vaccines.

The primary objectives of this study were
a) to evaluate if a previously established pH1N1 challenge model in Cynomolgus macaques can be used to measure vaccine-mediated protective efficacy, using a seasonal vaccine (Inflexal® V, season 2013/2014; Inflexal13/14) containing 15 µg FL HA of a H1N1 strain homologous to the challenge strain used.
b) to evaluate immunogenicity of s127H1-t2-cl18long (SEQ ID NO: 186) in non-human primates.

A secondary objective was to evaluate the protective efficacy of s127H1-t2-cl18long (SEQ ID NO:186) in this pH1N1 NHP challenge model.

A cohort of male cynomolgus macaques were pre-screened on the presence of serum antibodies against Alpha herpes virus, STLV, SIV, SRV and flu A NP, HAI titers against the challenge virus (allowing a maximum. titer of 1/10), as well as tested for tuberculosis by Mantoux and blood test. Some animals screened had been part of a previous CR8020 PK study. After screening, suitable animals were randomly allocated to 3 groups of 6 animals each, using a randomized block design taken, age, weight, HAI titer and inclusion in PK study into account. Dataloggers measuring body temperature with an 15 minute interval were implanted abdominally, followed by an 1 month recovery period after which the immunization regimen started. One group received 2 intramuscular (i.m.) immunizations with the human dose (0.5 mL) of Inflexal V 13/14, containing 15 µg FL HA of H1N1 A/California/07/09, which is the official guideline immunization regimen for naive children advocated by healthcare agencies (CDC, RIVM). The second group received 3 i.m. immunizations with 150 µg s127H1-t2-cl18long (SEQ ID NO: 186; containing an additional His-tag) protein adjuvanted with 50 µg Matrix-M in a volume of 0.5 mL. The third group was a negative control group which was administered 3 times 0.5 mL PBS i.m. All immunizations were performed with a 4-week immunization interval. Four weeks after the final immunizations animals were challenged intrabroncheally with $4 \times 10^6$ $TCID_{50}$ H1N1 A/Mexico/InDRE4487/2009, which was the dose established during setup of the model. During the 21 day follow-up period, clinical signs were recorded daily. Animals were anesthetized on day 1, 2, 4, 6, 8, 10, 14 and 21 during which bodyweight was measured, tracheal swabs taken to determine viral load by qPCR. At the end of the study, dataloggers were removed and data analysed.

To verify immunogenicity of the administered vaccines, serum was isolated on day of immunization, as well as S days before the challenge. For both vaccination treatments the pre-challenge serum response was analysed for breadth of binding to a panel of influenza A group 1 and 2 FL HA capability of vaccines to induce antibodies bind at close proximity to the CR9114 epitope, using a CR9114 competition ELISA with response expressed as % competition, surrogate ADCC activity of vaccine induced antibodies (see below) and neutralisation activity of vaccine-induced antibodies using both a microneutralisation assay against the heterosubtypic H5N1 A/HK/156/97 as well a HAI assay that detects virus neutralisation mediated by FL HA head epitopes, using H1N1 A/California/07/09. The latter strain is homologous to the vaccine and challenge strains.

A surrogate ADCC activity was determined using ADCC Bioassay effector cells (a stable Jurkat cell expressing human Fc gamma receptor IIIA (FcγRIIIA), human CD3γ, and an NFAT-response element regulating a luciferase reporter gene (Promega) and A549 target cells transiently transfected with DNA encoding FL HA of H1N1 and H5N1 strains.

Results

- No significant differences between treatment groups in tracheal viral load AUC were seen (not shown).
- Significant differences were seen in increase of body temperature (fever) post-challenge between Matrix-M adjuvanted polypeptide of the invention SEQ ID NO: 186 and PBS group during the day 0-3 (p=0.010) and day 0-8 (p=0.047) intervals (FIG. 27).
- Significant differences were seen in increase of body temperature post-challenge between Inflexal13/14 group and PBS group during the day 0-3 (p=0.033) interval (FIG. 27).
- Bodyweight and clinical signs were not informative due to the mild symptoms, likely predominantly determined by repeated anesthesia, and therefore not shown.
- Animal Ji0403061 (Inflexal13/14 group) died day 8 post challenge. Autopsy by veterinary pathologist determined viral pneumonia as cause of death, consistent with the high tracheal viral load up till time of death.
- An immunization regimen of 3×150 μg polypeptide of the invention SEQ ID NO: 186+50 μg Matrix-M was immunogenic:
  - Induction of group 1 HA binding antibodies (FIG. 23)
  - Induction of CR9114 competing antibodies against 3 different group 1 HA proteins (FIG. 24)
  - Induction of antibodies that neutralizes a heterosubtypic H5N1 strain using the micro neutralization assay (FIG. 26).
  - Induction of antibodies capable of ADCC effector functions using 3 different group 1 HA proteins as target HA (FIG. 25)

Conclusion: Demonstration of vaccine mediated intervention of disease in the H1N1 influenza challenge model in Cynomolgus macaques has only been partially successful, as only fever was significantly reduced in the first 3 days after challenge. Three immunizations with 3×150 μg H1 mini-HA #4900+50 μg Matrix-M is immunogenic in non-human primates. The induced antibodies are capable of binding HA and ADCC effector functions for all Group 1 full length HA's tested, and also neutralize a heterosubtypic H5 strain.

Example 17

Protection from Lethal Challenge with H5N1 A/Hong Kong/156/97 by Passive Transfer of Serum from Mice Immunized with Polypeptides of the Invention To determine the contribution of antibodies induced by polypeptides of the invention to protection observed, serum transfer studies were performed.

The aim of this study was to assess whether passive transfer (multiple dosing) of serum from mice immunized three times with s127H1-t2-cl18long (SEQ ID NO: 186) in the presence of Matrix-M confers protection to a lethal challenge with H5N1 Influenza A/Hong Kong/156/97.

Groups of female BALB/c donor mice (age 6-8 weeks) were immunized 3 times at a 3 week interval with 30 μg s127H1-t2-cl18long (SEQ ID NO:186) containing a C-terminal His-tag adjuvanted with 10 μg Matrix-M or immunized with PBS. Four weeks after the last immunization (d70) serum was isolated, pooled per group and transferred in recipient mice (female BALB/c, age 6-8 weeks, n=10 per group). Each mouse received 400 μl serum i.p. on three consecutive days before challenge (d-3, -2 and -1). As a positive control for the challenge model CR6261 (15 mg/kg) was administered 1 day prior to challenge (n=8), while injection with PBS served as a negative control (n=8). On day 0, mice were challenged with 12.5×LD50 H5N1 A/Hong Kong/156/97 and monitored (survival, weight, clinical scores) for 3 weeks.

To verify immunogenicity of H1 mini-HA variants in donor mice and asses HA-specific antibody levels after transfer of serum into recipient mice, pooled serum samples of terminal bleeds (d70) of donor mice, pooled serum samples of naïve recipient mice before serum transfer (d-4) as well as individual serum samples of recipient mice after 3 serum transfers just prior to challenge (d0), were tested in ELISA for binding to FL HA from H1N1 A/Brisbane/59/07.

Results

- Survival percentages for the experimental groups are reported in Table 12
- Experiment is valid; all mice in the PBS control group succumb to infection at or before day 13 post challenge (median 9.5 days), whereas the positive control group (15 mg/kg CR6261, 1 day before challenge) is fully protected ($p<0.001$).
- Three serum transfers of serum from Matrix-M adjuvanted s127H1-t2-cl18long (SEQ ID NO:186) immunized mice into naïve recipient mice leads to significant increase in survival proportion ($p<0.001$) (FIG. 28A), increase in survival time ($p<0.001$) (FIG. 28A), decrease in bodyweight loss ($p<0.001$) (FIG. 28B) and reduction in clinical score ($p<0.001$) (not shown), compared to the PBS serum transfer control group.
- FL HA A/Brisbane/59/07 specific antibody titers after three serum transfers are similar to levels obtained after active immunization. (FIG. 29)

Conclusion: Serum components (most likely antibodies) induced by 3 times immunization with Matrix-M adjuvanted H1 mini-HA #4900 are sufficient to protect mice against lethal challenge with heterosubtypic H5N1 A/Hong Kong/156/97.

Example 18

Revaluation of Protective Efficacy in a Lethal H1N1 A/Brisbane/59/07 Mouse Model In order to provide further evidence for the use of polypeptides of the invention as vaccines the protective efficacy of three additional polypeptides against lethal challenge with Influenza was evaluated. To this end polypeptides of the invention SEQ ID NO: 203 and 254 (both containing C-terminal his-tags) were transiently expressed in HEK293F cells and purified as described above. In addition, polypeptide of the invention SEQ ID NO: 186 (also containing an additional C-terminal his-tag) was expressed in SF9 insect cells following procedures well known to those skilled in the art (see e.g. M. Cox, Development of an influenza virus vaccine using the baculovirus-insect cell expression system, PhD thesis, Wageningen University December 2009) and purified as described above.

The aim of this study was to determine protective efficacy of polypeptides of the invention with Matrix-M in a H1N1 A/Brisbane/59/07 challenge model compared to a PBS control group.

Groups of 10 female BALB/c mice (age 6-8 weeks) were immunized 3 times at a 3 week interval with 30 μg polypeptide of the invention adjuvanted with 10 μg Matrix-M. As a positive control for the challenge model CR6261 (15 mg/kg) was administered 1 day prior to challenge (n=8), while injection with PBS served as a negative control (n=16). Four weeks after the last immunization mice were challenged with 12.5×LD50 challenge virus and monitored (survival, weight, clinical scores) for 3 weeks.

To verify immunogenicity of polypeptides of the invention, pre-challenge sera (day −1) were tested in ELISA assays for binding to FL HA from H1N1 A/Brisbane/59/07. To determine whether polypeptide of the invention induced antibodies bind at close proximity to the CR9114 epitope, a CR9114 competition ELISA was performed. Competition data were visualized as '% competition', defined as (A−P)/A×100), where A is the maximum OD signal of CR9114 binding to FL HA when no serum is present and P is the OD signal of CR9114 binding to FL HA in presence of serum at a given dilution or expressed using the slope OD metric to be able to quantify responses.

Results

- Survival percentages for the experimental groups are reported in Table 12.
- Experiment is valid; all mice in the PBS control group (n=16) succumb to infection at or before day 10 post challenge (median 8 days), whereas the positive control group (n=8, 15 mg/kg CR6261, 1 day before challenge) is fully protected ($p<0.001$).
- Three immunizations with polypeptides of the invention SEQ ID NO: 186, 203 and 254 adjuvanted with Matrix-M lead to significant increase in survival proportion ($p<0.001$) (FIG. 30A), increase in survival time ($p<0.001$) (FIG. 30A), decrease in bodyweight loss ($p<0.001$) (FIG. 30B) and reduction in clinical score ($p<0.001$) (not shown), compared to the PBS control group.
- Pre-challenge IgG antibody titers to H1N1 A/Brisbane/59/07 FL HA induced by polypeptides of the invention are significantly higher compared to PBS for all polypeptides of the invention tested ($p\leq0.001$) (FIG. 31A).
- IgG antibody titers to H1N1 A/Brisbane/59/07 FL HA plateau after two immunizations for all polypeptides of the invention tested (not shown).
- Matrix-M adjuvanted polypeptides of the invention SEQ ID NO: 186, 203 and 254 induce significantly higher CR9114 competition titers compared to PBS ($p<0.001$) (FIG. 31B).
- Matrix-M adjuvanted polypeptide of the invention SEQ ID NO: 203 (background H1N1 A/California/07/2009) induces significantly lower CR9114 competing antibodies compared to other polypeptides of the invention tested ($p\leq0.013$) when H1N1 A/Brisbane/59/07 FL HA is used as a target antigen (FIG. 31B).

Conclusion: Matrix-M adjuvanted additional polypeptide of the invention SEQ ID NO: 186, 203 and 254 confer protection against lethal challenge with H1N1 A/Brisbane/59/07.

Example 19

Evaluation of Protective Efficacy in a Lethal H1N1 A/NL/602/09 Mouse Model

In order to provide further evidence for the use of polypeptides of the invention as vaccines the protective efficacy of three additional polypeptides against lethal challenge with Influenza was evaluated. To this end polypeptides of the invention SEQ ID NO: 203 and 254 (both containing C-terminal his-tags) were transiently expressed in HEK293F cells and purified as described above. In addition polypeptide of the invention SEQ ID NO: 186 (also containing an additional C-terminal his-tag) was expressed in SF9 insect cells following procedures well known to those skilled in the art (supra) and purified as described above.

The aim of this study was to determine protective efficacy of additional trimeric H1 mini-HA variants adjuvanted with Matrix-M in a H1N1 A/NL/602/09 challenge model compared to a PBS control group.

Groups of 10 female BALB/c mice (age 6-8 weeks) were immunized 3 times at a 3 week interval with 30 μg polypeptide of the invention adjuvanted with 10 μg Matrix-M. As a positive control for the challenge model CR6261 (15 mg/kg) was administered 1 day prior to challenge (n=8), while injection with PBS served as a negative control (n=16). Four weeks after the last immunization mice were challenged with 12.5×LD50 challenge virus and monitored (survival, weight, clinical scores) for 3 weeks.

To verify immunogenicity of polypeptides of the invention, pre-challenge sera (day −1) are tested in ELISA assays for binding to FL HA from H1N1 A/Brisbane/59/07. To determine whether mini-HA induced antibodies bind at close proximity to the CR9114 epitope, a CR9114 competition ELISA was performed. Competition data were visualized as '% competition', defined as (A−P)/A×100), where A is the maximum OD signal of CR9114 binding to FL HA when no serum is present and P is the OD signal of CR9114 binding to FL HA in presence of serum at a given dilution or expressed using the slope OD metric to be able to quantify responses; for reference CR9114 and CR8020 (starting concentration 5 mg/ml) solutions were included.

Results

- Survival percentages for the experimental groups are reported in Table 12
- Experiment is valid; all mice in the PBS control group (n=16) succumb to infection at or before day 8 post challenge (median 6 days), whereas the positive control group (n=8, 15 mg/kg CR6261, 1 day before challenge) is fully protected ($p<0.001$).
- Three immunizations with polypeptides of the invention SEQ ID NO: 186, 203 and 254 adjuvanted with Matrix-M lead to significant increase in survival proportion ($p\leq0.004$) (FIG. 32A), increase in survival time ($p\leq0.001$) (FIG. 32A) and reduction in clinical score ($p<0.001$) (not shown), compared to the PBS control group. For polypeptides of the invention SEQ ID NO: 203 a significant reduction in body weight AUC is also observed ($p<0.001$) (FIG. 32B).
- Pre-challenge IgG antibody titers to H1N1 A/Brisbane/59/07 FL HA induced by polypeptides of the invention SEQ ID NO: 186, 203 and 254 are significantly higher compared to PBS ($p\leq0.001$) (FIG. 33A).
- Matrix-M adjuvanted polypeptides of the invention SEQ ID NO: 186, 203 and 254 induce significantly higher CR9114 competition titers compared to PBS ($p<0.001$) (FIG. 33B).
- Matrix-M adjuvanted trimeric polypeptide of the invention SEQ ID NO: 203 (background H1N1 A/California/07/2009) induces significantly lower CR9114 competing antibodies compared to variants derived from H1N1 A/Brisbane/59/2007 ($p\leq0.002$) when H1N1 A/Brisbane/59/07 FL HA is used as a target antigen (FIG. 33B).

Conclusion: Matrix-M adjuvanted polypeptides of the invention SEQ ID NO: 186, 203 and 254 confer protection against lethal challenge with H1N1 A/NL/602/09.

Example 20

H1 mHA Trimer Candidate Evaluation II in a H5N1 A/Hong Kong/156/97 Mouse Model In order to provide further evidence for the use of polypeptides of the invention as vaccines the protective efficacy of three additional polypeptides against lethal challenge with Influenza was evaluated. To this end polypeptides of the invention 203 and 254 (both containing C-terminal his-tags) were transiently expressed in HEK293F cells and purified as described above. In addition polypeptide of the invention SEQ ID NO: 186 (also containing an additional C-terminal his-tag) was expressed in SF9 insect cells following procedures well known to those skilled in the art and purified as described above.

The aim of this study was to determine protective efficacy of polypeptides of the invention SEQ ID NO: 186, 203 and 254 adjuvanted with Matrix-M in a H5N1 A/Hong Kong/156/97 challenge model compared to a PBS control group.

Groups of 10 female BALB/c mice (age 6-8 weeks) were immunized 3 times at a 3 week interval with 30 μg polypeptide of the invention adjuvanted with 10 μg Matrix-M. As a positive control for the challenge model CR6261 (15 mg/kg) was administered 1 day prior to challenge (n=8), while injection with PBS served as a negative control (n=16). Four weeks after the last immunization mice were challenged with 12.5×LD50 challenge virus and monitored (survival, weight, clinical scores) for 3 weeks.

To verify immunogenicity of polypeptides of the invention SEQ ID NO: 186, 203 and 254, pre-challenge sera (day −1) are tested in ELISA assays for binding to FL HA from H1N1 A/Brisbane/59/07. To determine whether mini-HA induced antibodies bind at close proximity to the CR9114 epitope, a CR9114 competition ELISA was performed. Competition data were visualized as '% competition', defined as (A−P)/A×100), where A is the maximum OD signal of CR9114 binding to FL HA when no serum is present and P is the OD signal of CR9114 binding to FL HA in presence of serum at a given dilution or expressed using the slope OD metric to be able to quantify responses; for reference CR9114 and CR8020 (starting concentration 5 μg/ml) solutions were included.

Results:

- Survival percentages for the experimental groups are reported in Table 12.
- Experiment is valid; 15 out of 16 mice in the PBS control group succumb to infection at or before day 9 post challenge (median 9 days), whereas the positive control group (n=8, 15 mg/kg CR6261, I day before challenge) is fully protected ($p<0.001$).
- Three immunizations with polypeptides of the invention SEQ ID NO: 186, 203 and 254 adjuvanted with Matrix-M lead to significant increase in survival proportion ($p<0.001$) (FIG. 34A), increase in survival time ($p<0.001$) (FIG. 34A), decrease in bodyweight loss ($p<0.001$) (FIG. 34B) and reduction in clinical score ($p<0.001$) (not shown), compared to the PBS control group.
- Pre-challenge IgG antibody titers to H1N1 A/Brisbane/59/07 FL HA induced by polypeptides of the invention SEQ ID NO: 186, 203 and 254 are significantly higher compared to PBS ($p<0.001$) (FIG. 35A).
- Matrix-M adjuvanted polypeptides of the invention SEQ ID NO: 186, 203 and 254 induce significantly higher CR9114 competition titers compared to PBS ($p<0.001$) (FIG. 35B).
- Matrix-M adjuvanted polypeptides of the invention SEQ ID NO: 203 (background H1N1 A/California/07/2009) induces significantly lower CR9114 competing antibodies compared to polypeptides of the invention SEQ ID NO: 186 and 254 (background H1N1 A/Brisbane/59/2007) when H1N1 A/Brisbane/59/07 FL HA is used as a target antigen ($p<0.001$) (FIG. 35B).

Conclusion: Matrix-M adjuvanted polypeptides of the invention SEQ ID NO: 186, 203 and 254 confer protection against lethal challenge with heterosubtypic H5N1 A/Hong Kong/156/97.

Example 21

H1 mHA Trimer Candidate Evaluation II in a H1N1 A/Puerto Rico/8/34 Mouse Model

In order to provide further evidence for the use of polypeptides of the invention as vaccines the protective efficacy of three additional polypeptides against lethal challenge with Influenza was evaluated. To this end polypeptides of the invention 203 and 254 (both containing C-terminal his-tags) were transiently expressed in HEK293F cells and purified as described above. In addition polypeptide of the invention SEQ ID NO: 186 (also containing an additional C-terminal his-tag) was expressed in SF9 insect cells following procedures well known to those skilled in the art and purified as described above.

The aim of this study was to determine protective efficacy of polypeptides of the invention SEQ ID NO: 186, 203 and 254 adjuvanted with Matrix-M in a H1N1 A/Puerto Rico/8/1934 challenge model compared to a PBS control group.

Groups of 10 female BALB/c mice (age 6-8 weeks) were immunized 3 times at a 3 week interval with 30 μg of polypeptides of the invention SEQ ID NO: 186, 203 and 254 adjuvanted with 10 μg Matrix-M. As a positive control for the challenge model CR6261 (15 mg/kg) was administered I day prior to challenge (n=8), while 3 immunizations with PBS served as a negative control (n=16). Four weeks after the last immunization mice were challenged with 25×LD50 challenge virus and monitored (survival, weight, clinical scores) for 3 weeks.

To verify immunogenicity of polypeptides of the invention, pre-challenge sera (day −1) are tested in ELISA assay for binding to FL HA from H1N1 A/Brisbane/59/07. To determine whether mini-HA induced antibodies bind at close proximity to the CR9114 epitope, a CR9114 competition ELISA was performed. Competition data were visualized as '% competition', defined as (A−P)/A×100), where A is the maximum OD signal of CR9114 binding to FL HA when no serum is present and P is the OD signal of CR9114 binding to FL HA in presence of serum at a given dilution or expressed using the slope OD metric to be able to quantify responses; for reference CR9114 and CR8020 (starting concentration 5 μg/ml) solutions were included.

Results

- Survival percentages for the experimental groups are reported in Table 12.
- Experiment is valid; all mice in the PBS control group (n=16) succumb to infection at or before day 9 post challenge (median 8 days), whereas the positive control group (n=8, 15 mg/kg CR6261, I day before challenge) is fully protected ($p<0.001$).
- Three immunizations with polypeptides of the invention SEQ ID NO: 186, 203 and 254 adjuvanted with Matrix-M lead to significant increase in survival proportion ($p<0.001$) (FIG. 36A), increase in survival time (p<0.001) (FIG. 36A), decrease in bodyweight loss (p<0.001) (FIG. 37B) and reduction in clinical score (p<0.001) (not shown), compared to the PBS control group.

Pre-challenge IgG antibody titers to H1N1 A/Brisbane/ 59/07 FL HA induced by H1 mini-HA variants are significantly higher compared to PBS for polypeptides of the invention SEQ ID NO: 186, 203 and 254 (p<0.001) (FIG. 37A).

Matrix-M adjuvanted polypeptides of the invention SEQ ID NO: 186, 203 and 254 induce significantly higher CR9114 competition titers compared to PBS (p<0.001) (FIG. 37B).

Matrix-M adjuvanted polypeptide of the invention SEQ ID NO: 203 (background H1N1 A/California/07/2009) induces significantly lower CR9114 competing antibodies compared to variants based on H1N1 A/Brisbane/59/2007 when H1N1 A/Brisbane/59/07 FL HA is used as a target antigen (p≤0.001) (FIG. 37B).

Conclusion: Matrix-M adjuvanted polypeptides of the invention SEQ ID NO: 186, 203 and 254 confer protection against lethal challenge with H1N1 A/Puerto Rico/8/34.

Example 22

Polypeptide of the Invention in Different H1 Sequence Backgrounds

Next to s127H1-t2-cl18long (SEQ ID NO: 181) two variants, Tex_s127H1-t2-cl18long and NY_s127H1-t2-cl18long, were produced (SEQ ID NO: 208 and 210) that share the same design features, however, are based on the HA originating from strains H1N1 A/Texas/UR06-0526/07 (SEQ ID NO: 205) and A/New York/629/95 (SEQ ID NO: 206). In this experiment a C-terminal Factor X cleavage site and 6 histidine tag are present in both proteins. For expression and purification a protocol similar to described in Example 2 (was used with the exception the procedure was started out with 0.6 l culture supernatant.

Purified polypeptides were further analyzed in a sandwich ELISA (as described in Example 3) for the presence of multimeric forms of polypeptides that present two or more epitopes of the broadly neutralizing antibody CR9114. In short, coated mAb CR9114 was used to capture the purified proteins which were subsequently incubated with biotinylated CR914 or CR6261 and binding was assessed by HRP-conjugated streptavidin. Production yields and Multimer sandwich ELISA results are shown in table 13.

Results shown in table 13 indicate that all variants result in multimeric protein with desired binding characteristics. Polypeptide Tex_s127H1-t2-cl18 (SEQ ID NO: 208) has a similar yield compared to s127H1-t2-cl18long whereas polypeptide NY_s127H1-t2-cl18 (SEQ ID NO: 210) has a ~4 fold lower yield compared to s127H1-t2-cl18long (SEQ ID NO: 181). All polypeptides tested were capable of binding to CR9114 and CR6261 similarly to s127H1-t2-cl18long as determined by ELISA which indicates the presence of multimerization. Taken together, the results shown here demonstrate the successful generation of HA stem based polypeptides using H1 sequence of different phylogenetic origin.

Example 23

Polypeptides of the Invention with Additional c-Terminal Trimerization Domain

Polypeptides of the invention can be expressed with a variety of c-termini. Besides different length (resulting from alternative truncations of the transmembrane domain of HA) also tags for detection and purification as well as functional domains can be added without affecting the antigen structure. The constructs below demonstrate the addition of a foldon trimerization domain (flanked by a Flag- and a His-tag) to short (deleting residue 520 to the C-terminus; numbering according to SEQ ID NO: 1) or long (deleting residue 520 to the C-terminus) versions of polypeptides of the invention derived from FL HA from H1 A/Brisbane/59/ 2007 (SEQ ID NO: 1) or H1 A/California/07/2009 (SEQ ID NO: 252).

The constructs were transiently expressed in HEK293F cells (as described in Example 2) and the polypeptides of the invention present in the filtered culture supernatant investigated. The levels of expression and trimerization were first assessed by SDS-PAGE and Western Blot (as described in Example 2, see FIG. 38). Culture medium was further analyzed in a sandwich ELISA (as described in Example 3) for the presence of multimeric forms of polypeptides that present two or more epitopes of the broadly neutralizing antibody CR9114. In short, coated mAb CR9114 was used to capture the purified proteins which were subsequently incubated with biotinylated CR914 and binding was assessed by HRP-conjugated streptavidin (see Table 14). Lastly, homogeneous binding studies were performed to confirm the expression level of the polypeptides of the invention as well as to determine their binding strength to well characterized monoclonal antibodies (IgG) with known epitopes on the stem of HA. Hereto an AlphaLISA setup (Perkin Elmer) was established which relied on the c-terminal Flag- and His-tags as well as the human monoclonal IgGs CR9114 and CR6261. All reagents were diluted in buffer containing PBS, 0.05% Tween-20, and 0.5 mg/ml BSA.

To determine the expression level using the AlphaLISA setup, the filtered cell culture supernatants containing the polypeptides of the invention (were diluted 40 times in the presence of an anti-His donor bead and an anti-Flag acceptor bead, both from Perkin Elmer and at 10 μg/mL in a final volume of 25 μL. The homogeneous mixture was incubated for 1 h at RT. If the excited donor bead (680 nm) and acceptor bead both bind the respective c-terminal tags and come in close proximity (~100 nm), an energy transfer (singlet oxygen) can be measured as a luminescence signal of the acceptor bead (615 nm). The signal intensity in this homogeneous assay format is directly proportional to the amount of protein in solution. Averages of AlphaLISA signal intensities for the expressed polypeptides of the invention are shown in Table 14.

The interaction between the polypeptides of the invention and the IgGs was detected after 1 h incubation with either CR9114 or CR6261 (1 or 2 nM final concentration respectively, in 25 μL) at RT with two beads, an anti-His donor bead recognizing HA (10 μg/mL) and an anti-Fc acceptor bead (10 μg/mL) recognizing the IgG used. After an additional hour of incubation the AlphaLISA signal of the acceptor bead was measured. The signal intensity in this homogeneous assay format is directly proportional to the binding strength (affinity/avidity) between both binding partners and is thereby a measure for the integrity and quality of the mini-HA epitope. Averages of AlphaLISA signal intensities for the binding of CR9114 and CR6261 are shown in Table 14.

The parent constructs SEQ ID NO: 164 (H1 A/Brisbane/ 59/2007 background) and SEQ ID NO: 211 (H1 A/California/07/2009 background) already contain a GCN4 trimerization domain embedded in the C-helix. The insertion of an additional foldon trimerization domain at the c-terminus of soluble versions of these polypeptides (also included in the invention) is possible and results in similar or better expression levels. The additional trimerization domain may further improve the polypeptide of the invention with respect to the level of trimerization as evident by the Western Blot and multimer ELISA results. The binding of broadly neutralizing IgGs CR9114 and CR6261 is equal or better compared to polypeptides of the invention with only one trimerization domain.

TABLE 1

Standard amino acids, abbreviations and properties

| Amino Acid | 3-Letters | 1-Letter | Side chain polarity | Side chain charge (pH 7.4) |
|---|---|---|---|---|
| alanine | Ala | A | nonpolar | Neutral |
| arginine | Arg | R | polar | Positive |
| asparagine | Asn | N | polar | Neutral |
| aspartic acid | Asp | D | polar | Negative |
| cysteine | Cys | C | nonpolar | Neutral |

TABLE 1-continued

Standard amino acids, abbreviations and properties

| Amino Acid | 3-Letters | 1-Letter | Side chain polarity | Side chain charge (pH 7.4) |
|---|---|---|---|---|
| glutamic acid | Glu | E | polar | Negative |
| glutamine | Gln | Q | polar | Neutral |
| glycine | Gly | G | nonpolar | Neutral |
| histidine | His | H | polar | positive (10%) neutral(90%) |
| isoleucine | Ile | I | nonpolar | Neutral |
| leucine | Leu | L | nonpolar | Neutral |
| lysine | Lys | K | polar | Positive |
| methionine | Met | M | nonpolar | Neutral |
| phenylalanine | Phe | F | nonpolar | Neutral |
| proline | Pro | P | nonpolar | Neutral |
| serine | Ser | S | polar | Neutral |
| threonine | Thr | T | polar | Neutral |
| tryptophan | Trp | W | nonpolar | Neutral |
| tyrosine | Tyr | Y | polar | Neutral |
| valine | Val | V | nonpolar | Neutral |

TABLE 2

Sequence alignment of H1 sequences according to particular embodiments of the invention

```
 1. A/Solomon Islands/6/2003 (H1N1)          (SEQ ID NO: 25)
 2. A/Brisbane/59/2007 (H1N1)                (SEQ ID NO: 1)
 3. A/New Caledonia/20/1999(H1N1)            (SEQ ID NO: 26)
 4. A/California/07/2009 (H1N1)              (SEQ ID NO: 27)
 5. A/swine/Hubei/S1/2009(H1N1)              (SEQ ID NO: 28)
 6. A/swine/Haseluenne/IDT2617/2003(H1N1)    (SEQ ID NO: 29)
 7. A/NewYork/8/2006(H1N1)                   (SEQ ID NO: 30)
 8. A/SolomonIslands/3/2006(H1N1)            (SEQ ID NO: 31)
 9. A/New York/146/2000(H1N1)                (SEQ ID NO: 32)
10. A/New York/653/1996(H1N1)                (SEQ ID NO: 33)
11. A/Beijing/262/1995(H1N1)                 (SEQ ID NO: 34)
12. A/Texas/36/1991(H1N1)                    (SEQ ID NO: 35)
13. A/Singapore/6/1986(H1N1)                 (SEQ ID NO: 36)
14. A/Chile/1/1983(H1N1)                     (SEQ ID NO: 37)
15. A/Baylor/11515/1982(H1N1)                (SEQ ID NO: 38)
16. A/Brazil/11/1978(H1N1)                   (SEQ ID NO: 39)
17. A/USSR/90/1977(H1N1)                     (SEQ ID NO: 40)
18. A/NewJersey/8/1976(H1N1)                 (SEQ ID NO: 41)
19. A/Denver/1957(H1N1)                      (SEQ ID NO: 42)
20. A/Albany/4835/1948(H1N1)                 (SEQ ID NO: 43)
21. A/FortMonmouth/1/1947(H1N1)              (SEQ ID NO: 44)
22. A/Cameron/1946(H1N1)                     (SEQ ID NO: 45)
23. A/Weiss/1943(H1N1)                       (SEQ ID NO: 46)
24. A/Iowa/1943(H1N1)                        (SEQ ID NO: 47)
25. A/Bellamy/1942(H1N1)                     (SEQ ID NO: 48)
26. A/PuertoRico/8/1934(H1N1)                (SEQ ID NO: 49)
27. A/WSN/1933(H1N1)                         (SEQ ID NO: 50)
28. A/SouthCarolina/1/1918(H1N1)             (SEQ ID NO: 51)

1.  MKVKLLVLLC TFTATYADTI CIGYHANNST DTVDTVLEKN VTVTHSVNLL EDSHNGKLCL   60
 2.  MKVKLLVLLC TFTATYADTI CIGYHANNST DTVDTVLEKN VTVTHSVNLL ENSHNGKLCL   60
 3.  MKAKLLVLLC TFTATYADTI CIGYHANNST DTVDTVLEKN VTVTHSVNLL EDSHNGKLCL   60
 4.  MKAILVVLLY TFATANADTL CIGYHANNST DTVDTVLEKN VTVTHSVNLL EDKHNGKLCK   60
 5.  MEAKLFVLFC AFTALKADTF CVGYHANYST HTVDTILEKN VTVTHSVNLL ENSHNGKLCS   60
 6.  MEAKLFVLFC AFTALKADTI CVGYHANNST DTVDTILEKN VTVTHSINLL ENNHNGKLCS   60
 7.  MKVKLLVLLC TFTATYADTI CIGYHANNST DTVDTVLEKN VTVTHSVNLL EDSHNGKLCL   60
 8.  MKVKLLVLLC TFTATYADTI CIGYHANNST DTVDTVLEKN VTVTHSVNLL EDSHNGKLCL   60
 9.  MKAKLLVLLC AFTATYADTI CIGYHANNST DTVDTVLEKN VTVTHSVNLL EDSHNGKLCR   60
10.  MKAKLLVLLC AFTATYADTI CIGYHANNST DTVDTVLEKN VTVTHSVNLL EDSHNGKLCR   60
11.  MKAKLLVLLC TFTATYADTI CIGYHANNST DTVDTVLEKN VTVTHSVNLL EDSHNGKLCL   60
12.  MKAKLLVLLC AFTATYADTI CIGYHANNST DTVDTVLEKN VTVTHSVNLL EDSHNGKLCR   60
13.  MKAKLLVLLC AFTATDADTI CIGYHANNST DTVDTVLEKN VTVTHSVNLL EDSHNGKLCR   60
14.  MKAKLLVLLC ALSATDADTI CIGYHANNST DTVDTVLEKN VTVTHSVNLL EDNHNGKLCK   60
15.  MKAKLLVLLC ALSATDADTI CIGYHANNST DTVDTVLEKN VTVTHSVNLL EDSHNGKLCR   60
16.  MKAKLLVLLC ALSATDADTI CIGYHANNST DTVDTVLEKN VTVTHSVNLL EDSHNGKLCR   60
17.  MKAKLLVLLC ALSATDADTI CIGYHANNST DTVDTVLEKN VTVTHSVNLL EDSHNGKLCR   60
18.  MKAKLLVLLC AFTATDADTI CIGYHANNST DTVDTVLEKN VTVTHSVNLL EDSHNGKLCR   60
19.  MKAKLLILLC ALSATDADTI CIGYHANNST DTVDTVLEKN VTVTHSVNLL EDSHNGKLCR   60
20.  MKAKLLVLLC ALSATDADTI CIGYHANNST DTVDTVLEKN VTVTHSVNLL EDSHNGKLCR   60
```

TABLE 2-continued

Sequence alignment of H1 sequences according to particular embodiments of the invention

```
21.  MKAKLLILLC ALTATDADTI CIGYHANNST DTVDTVLEKN VTVTHSVNLL EDSHNGKLCR   60
22.  MKAKLLILLC ALSATDADTI CIGYHANNST DTVDTVLEKN VTVTHSVNLL EDSHNGKLCR   60
23.  MKARLLVLLC ALAATDADTI CIGYHANNST DTVDTILEKN VTVTHSVNLL EDSHNGKLCR   60
24.  MKARLLVLLC ALAATDADTI CIGYHANNST DTVDTVLEKN VTVTHSVNLL EDSHNGKLCR   60
25.  MKARLLVLLC AIAATDADTI CIGYHANNST DTVDTILEKN VTVTHSVNLL EDSHNGKLCR   60
26.  MKANLLVLLC ALAAADADTI CIGYHANNST DTVDTVLEKN VTVTHSVNLL EDSHNGKLCR   60
27.  MKAKLLVLLY AFVATDADTI CIGYHANNST DTVDTIFEKN VAVTHSVNLL EDRHNGKLCK   60
28.  MEARLLVLLC AFAATNADTI CIGYHANNST DTVDTVLEKN VTVTHSVNLL EDSHNGKLCK   60
     *:. *::**  :: :: ***: ********** *****::*** *:******** *: ******

1.  LKGIAPLQLG NCSVAGWILG NPECELLISR ESWSYIVEKP NPENGTCYPG HFADYEELRE   120
 2.  LKGIAPLQLG NCSVAGWILG NPECELLISK ESWSYIVEKP NPENGTCYPG HFADYEELRE   120
 3.  LKGIAPLQLG NCSVAGWILG NPECELLISK ESWSYIVETP NPENGTCYPG YFADYEELRE   120
 4.  LRGVAPLHLG KCNIAGHILG NPECESLSTA SSWSYIVFTP SSDNGTCYPG DFIDYEELRE   120
 5.  LNGKIPLQLG NCNVAGWILG NPKCDLLLTA NSSSYIIETS KSKNGACYPG EFADYEELKE   120
 6.  LNGKAPLQLG NCNVAGHILG NPECDLLLTV DSWSYIIETS NSKNGACYPG EFADYEELKE   120
 7.  LKGIAPLQLG NCSVAGHILG NPECELLISK ESWSYIVETP NPENGTCYPG YFADYEELRE   120
 8.  LKGIAPLQLG NCSVAGHILG NPECELLISR ESWSYIVEKP NPENGTCYPG HFADYEELRE   120
 9.  LKGTAPLQLG NCSIAGHILG NPECESLFSK ESWSYIAETP NPKNGTCYPG YFADYEELRE   120
10.  LKGTAPLQLG NCSVAGHILG NPECESLFSK ESWSYIAETP NPENGTCYPG YFADYEELRE   120
11.  LKGIAPLQLG NCSVAGHILG NPECESLISK ESWSYIVETP NPENGTCYPG YFADYEELRE   120
12.  LKGIAPLQLG NCSVAGWILG NPKCESLFSK ESWSYIAETP NPENGTCYPG YFADYEELRE   120
13.  LKGIAPLQLG NCSIAGHILG NPECESLFSK KSWSYIAETP NSENGTCYPG YFADYEELRE   120
14.  LKGIAPLQLG KCSIACWILG NPECESLFSK KSWSYIAETP NSENGTCYPG YFADYEELRE   120
15.  LKGIAPLQLG KCSIAGWILG NPECESLFSK KSWSYIAETP NSENGTCYPG YFADYEELRE   120
16.  LKGIAPLQLG KCSIAGWILG NPECESLFSK KSWSYIAETP NSENGTCYPG YFADYEELRE   120
17.  LKGIAPLQLG KCNIAGHILG NPECESLFSK KSWSYIAETP NSENGTCYPG YFADYEELRE   120
18.  LKGIAPLQLG NCSIAGHILG NPECESLFSK KSWSYIAETP NSENGTCYPG YFADYEELRE   120
19.  LKGKAPLQLG NCNIAGWVLG NPECESLLSN RSWSYIAETP NSENGTCYPG DFADYEELRE   120
20.  LKGIAPLQLG KCNIAGHILG NPECESLFSK KSWSYIAETP NSENGTCYPG YFADYEELRE   120
21.  LKGIAPLQLG KCNIAGHILG NPECESLLSK RSWSYIAETP NSENGACYPG DFADYEELRE   120
22.  LKGIAPLQLG KCNIAGHILG NPECESLLSK RSWSYIAETP NSENGACYPG DFADYEELRE   120
23.  LKGIAPLQLG KCNIAGHILG NPECESLLSE RSWSYIVEIP NSENGTCYPG DFTDYEELRE   120
24.  LKGIAPLQLG KCNIAGHILG NPECESLLSE RSWSYIVETP NSENGTCYPG DFIDYEELRE   120
25.  LKGIAPLQLG KCNIAGHILG NPECESLLSE RSWSYIVETP NSENGTCYPG DFIDYEELRE   120
26.  LKGIAPLQLG KCNIAGHLLG NPECDPLLPV RSWSYIVETP NSENGICYPG DFIDYEELRE   120
27.  LKGIAPLQLG KCNITGHLLG NPECDSLLPA RSWSYIVETP NSENGACYPG DFIDYEELRE   120
28.  LKGIAPLQLG KCNIAGHLLG NPECDLLLTA SSWSYIVETS NSENGTCYPG DFIDYEELRE   120
     *:* ***:** :*.::**:** **:*: * .   *****.* .  ...** ****  * *******

1.  QLSSVSSFER FEIFPKESSW PNHTTT-GVS ASCSHNGESS FYKNLLWLTG KNGLYPNLSK   179
 2.  QLSSVSSFEP FEIFPKESSW PNHTVT-GVS ASCSHNGESS FYRNLLWLTG KNGLYPNLSK   179
 3.  QLSSVSSFER PEIFPKESSW PNHTVT-GVS ASCSHNGKSS FYRNLLWLTG KNGLYPNLSK   179
 4.  QLSSVSSFER FEIFPKTSSW PNHDSNKGVT AACPHAGAKS FYKNLIWLVK KCNSYPKLSK   180
 5.  QLSTVSSFER FEIFPKAISW PDHDATRGTT VACSHSGVNS FYRNLLSTVK KGNSYPKLSK   180
 6.  OLSTVSSFER FEIFPKATSW PNHDTTRGTT ISCSHSGANS FYRNLLHIVK KGNSYPKLSK   180
 7.  QLSSVSSFER FEIFPKESSW PNHTVT-GVS ASCSHNGKSS FYRNLLWLTG KNGLYPNLSK   179
 8.  QLSSVSSFER FEIFPKESSW PNHTTT-GVS ASCSHNGESS PYKNLLWLTG KNGLYPNLSK   179
 9.  QLSSVSSFER FEIFPKDSSW PNHTVTKGVT ASCSHNGKSS FYKNLLWLTE KNGLYPNLSK   180
10.  QLSSVSSFER FEIFPKESSH PNHTVTKGVT ASCSHNGKSS FYKNLLWLTE KNGLYPNLSK   180
11.  QLSSVSSFER FEIFPKESSH PNHTVT-GVT ASCSHNGKSS FYRNLLWLTE KNGLYPNLSN   179
12.  QLSSVSSFER FEIFPKESSW PNHTVTKGVT TSCSHNGKSS FYRNLLWLTK KNGLYPNVSK   180
13.  QLSSVSSFER FEIFPKESSW PNHTVTKGVT ASCSHKGRSS FYRNLLWLTK KNGSYPNLSK   180
14.  QLSSVSSFER FEIFPKESSW PKHNVTKGVT AACSHKGKSS FYRNLLWLTE KNGSYPNLSK   180
15.  QLSSVSSFER FEIFPKESSW PKHSVTRGVT ASCSHKGKSS FYRNLLWLTE KNGSYPNLSK   180
16.  QLSSVSSFER FEIFPKERSW PKHNITRGVT ASCSHKGKSS FYRNLLWLTE KNGSYPNLSK   180
17.  QLSSVSSFER FEIFPKERSW PKHHVTRGVT ASCSHKGKSS FYRNLLWLTE KNGSYPNLSK   180
18.  QLSSVSSFER FEIFPKESSH PNHTVTKGVT ASCSHKGRSS FYRNLLWLTK KNGSYPNLSK   180
19.  QLSSVSSFEP FEIFPKERSW PNHTTR-GVT AACPHARKSS FYKNLVWLTE ANGSYPNLSR   179
20.  QLSSVSSFER FEIFPKERSW PKHNITRGVT AACSHKGKSS FYRNLLWLTE KNGSYPNLHK   180
21.  QLSSVSSFER FEIFPKERSW PKHNITRGVT AACSHAGKSS FYKNLLWLTE TDGSYPKLSK   180
22.  QLSSVSSFER FEIFPKGRSW PEHNIDIGVT AACSHAGKSS FYKNLLWLTE KDGSYPNLNK   180
23.  QLSSVSSFER FEIFPKESSH PKHNTAPGVT AACSHAGKSS FYRNLLWLTE KDGSYPNLKN   130
24.  QLSSVSSFER FEIFSKESSW PKHTTG-GVT AACSHAGKSS FYRNLLWLTE KDGSYPNLNN   179
25.  QLSSVTSFER FEIFPKETSW PKHNTTKGVT AACSHAGKCS FYRNLLWLTE KDGSYPNLNN   180
26.  QLSSVSSFER FEIFPKESSH PNHNTN-GVT AACSHEGKSS FYRNLLWLTE KECSYPKLKN   179
27.  QLSSVSSLER FEIFPKESSW PNHTFN-GVT VSCSHRGKSS FYRNLLHLTK KGDSYPKLTN   179
28.  QLSSVSSFEK FEIFPKTSSH PNHETTKGVT AACSYAGASS FYRNLLWLTK KGSSYPKLSK   180
     *****:*:*: ****.*  **  *:*   **: .:*.:    * **:**:**.     . **:::..

1.  SYANNKEKEV LVLWGVHHPP NIGDQRALYH KENAYVSVVS SHYSRKFTPE IAKRPKVRDQ   239
 2.  SYANNKEKEV LVLWGVHHPP NIGNQKALYH TENAYVSVVS SHYSRKFTPE IAKRPKVRDQ   239
 3.  SYVNNKEKEV LVLWGVHHPP NIGNQRALYH TENAYVSVVS SHYSRRFTPE IAKRPKVRDQ   239
 4.  SYINDKGKEV LVLWGIHHPS TSADQQSLYQ NADAYVFVGS SRYSKKFKPE IAIRPKVRXX   240
 5.  SYTNNKGKEV LVIWGVHHPP TDSVQQTLYQ NKHTYVSVGS SKYYKRFTPE IVARPKVRGQ   240
 6.  SYTNNKGKEV LVIWGVHHPP TDSDQQTLYQ NNHTYVSVGS SKYYQRFTPE IVTRPKVRGQ   240
 7.  SYANNKEKEV LVLWGVHHPP NIGDQRALYH TENAYVSVVS SHYSRRFTPE IAKRPKVRDQ   239
```

TABLE 2-continued

Sequence alignment of H1 sequences according to particular embodiments of the invention

| | | | | | | | |
|---|---|---|---|---|---|---|---|
| 8. | SYANNKEKEV | LVLWGVHHPP | NIGDQRALYH | KENAYVSVVS | SHYSRKFTPE | IAKRPKVRDQ | 239 |
| 9. | SYVNKKGKEV | LVLWGVHHPS | NMGDQRAIYH | KENAYVSVLS | SHYSRRFTPE | IAKRPKVRDQ | 240 |
| 10. | SYVNNKEKEV | LVLWGVHHPS | NIGDQRAIYH | TENAYVSVVS | SHYSRRFTPE | ITKRPKVRDQ | 240 |
| 11. | SYVNNKEKEV | LVLWGVHHPS | NIRDQRAIYH | TENAYVSVVS | SHYSRRFTPE | IAKRPKVRGQ | 239 |
| 12. | SYVNNKEKEV | LVLWGVHHPS | NIGDQRAIYH | TENAYVSVVS | SHYSRRFTPE | IAKRPKVRDQ | 240 |
| 13. | SYVNNKEKEV | LVLWGVHHPS | NIGDQRAIYH | TENAYVSVVS | SHYNRRFTPE | IAKRPKVRDQ | 240 |
| 14. | SYVNNKEKEV | LVLWGVHHPS | NIEDQKTIYR | KENAYVSVVS | SHYNRRFTPE | IAKRPKVRNQ | 240 |
| 15. | SYVNDKEKEV | LVLWGVHHPS | NIEDQKTIYR | KENAYVSVVS | SHYNRRFTPE | IAKRPKVRDQ | 240 |
| 16. | SYVNNKEKEV | LVLWGVHHPS | NIEDQKTIYR | KENAYVSVVS | SNYNRRFTPE | IAKRPKVRGQ | 240 |
| 17. | SYVNNKEKEV | LVLWGVHHPS | NIEDQKTIYR | KENAYVSVVS | SNYNRRFTPE | IAERPKVRGQ | 240 |
| 18. | SYVNNKEKEV | LVLWGVHHPS | NIGDQRAIYH | TENAYVSVVS | SHYNRRFTPE | IAKRPKVRDQ | 240 |
| 19. | SYVNNQEKEV | LVLWGVHHPS | NIEEQRALYR | KDNAYVSVVS | SNYNRRFTPE | IAKRPKVRDQ | 239 |
| 20. | SYVNNKEKEV | LVLWGVHHPS | NIEDQKTLYR | KENAYVSVVS | SNYNRRFTPE | IAERPKVRGQ | 240 |
| 21. | SYVNNKEKEV | LVLWGVHHPS | NIEDQKTLYR | KENAYVSVVS | SNYNRRFTPE | IAERPKVRGQ | 240 |
| 22. | SYVNKKEKEV | LILWGVHHPP | NIENQKTLYR | KENAYVSVVS | SNYNRRFTPE | IAERPKVRGQ | 240 |
| 23. | SYVNKKGKEV | LVLWGVHHPS | SIKEQQTLYQ | KENAYVSVVS | SNYNRRFTPE | IAERPKVRDQ | 240 |
| 24. | SYVNKKGKEV | LVLWGVHHPS | NIKDQQTLYQ | KENAYVSVVS | SNYNRRFTPE | IAERPKVRGQ | 239 |
| 25. | SYVNKKGKEV | LVLWGVHHPS | NIKDQQTLYQ | KENAYVSVVS | SNYNRRFTPE | IAERPKVRGQ | 240 |
| 26. | SYVNKKGKEV | LVLWGIHHPP | NSKEQQNLYQ | NENAYVSVVT | SNYNRRFTPE | IAERPKVRDQ | 239 |
| 27. | SYVNNKGKEV | LVLWGVHHPS | SSDBQQSLYS | NGNAYVSVAS | SNYNRRFTPE | IAARPKVKDQ | 239 |
| 28. | SYVNNKGKEV | LVLWGVHHPP | TGTDQQSLYQ | NADAYVSVGS | SKYNRRFTPE | IAARPKVRDQ | 240 |
| | ** *.: *** *:***:***. . :*: :* . :*** * : *.*.::*.** *: ****: | | | | | | |
| 1. | EGRINYYWTL | LEPGDTIIFE | ANGNLIAPRY | AFALSRGFGS | GIINSNAPMD | ECDAKCQTPQ | 299 |
| 2. | EGRINYYWTL | LEPGDTIIFE | ANGNLIAPRY | AFALSRGFGS | GIINSNAPMD | KCDAKCQTPQ | 299 |
| 3. | EGRINYYWTL | LEPGDTIIFE | ANGNLIAPWY | AFALSRGFGS | GIITSNAPMD | ECDAKCQTPQ | 299 |
| 4. | EGRMNYYWTL | VEPGDKITFE | ATGNLVVPRY | AFAMERNAGS | GIIISDTPVH | DCNTTCQTPK | 300 |
| 5. | AGRMNYYWTL | FDQGDTITFE | ATGNLIAPWH | AFALKKGSSS | GIMLSDAQVH | NCTTKCQTPH | 300 |
| 6. | AGRMNYYWTL | LDQGDTITFE | ATGNLIAPWH | AFALNKGPSS | GIMISDAHVH | NCTTKCQTPH | 300 |
| 7. | EGRINYYWTL | LEPGDTIIFE | ANGNLIAPRF | AFALSRGFGS | GIITSNAPMD | ECDAKCOTPO | 299 |
| 8. | EGRINYYWTL | LEPGDTIIFE | ANGNLIAPRY | AFALSRGFGS | GIINSNAPMD | ECDAKCQTPQ | 299 |
| 9. | EGRINYYWTL | LEPGDTIIFE | ANGNLIAPWY | AFALSRGFGS | GIIISNASMG | ECDAKCQTPQ | 300 |
| 10. | EGRINYYWTL | LEPGDTIIFE | ANGNLIAPWY | AFALSRGFGS | GIITSNASMG | ECDAKCQTPQ | 300 |
| 11. | EGRINYYWTL | LEPGDTIIFE | ANGNLIAPWY | AFALSRGFGS | GIITSNAPMN | ECDAKCQTPQ | 299 |
| 12. | EGRINYYWTL | LEPGDTIIFE | ANGNLIAPWY | AFALSRGFGS | GIITSNASMD | ECDAKCQTPQ | 300 |
| 13. | EGRINYYWTL | LEPGDTIIFE | ANGNLIAPWY | AFALSRGFGS | GIITSNASMD | ECDAKCQTPQ | 300 |
| 14. | EGRINYYWTL | LEPGDTIIFE | ANGNLIAPWY | AFALSRGFGS | GIITSNASMD | ECDAKCQTPQ | 300 |
| 15. | EGRINYYWTL | LEPGDTIIFE | ANGNLIAPWY | AFALSRGFGS | GIITSNVSMD | ECDAKCQTPQ | 300 |
| 16. | EGRINYYWTL | LEPGDTIIFE | ANGNLIAPWY | AFALSRGFGS | GIITSNASMD | ECDTKCQTPQ | 300 |
| 17. | AGRINYYWTL | LEPGDTIIFE | ANGNLIAPWH | AFALNRGFGS | GIITSNASMD | ECDTKCQTPQ | 300 |
| 18. | EGRINYYWTL | LEPGDTIIFE | ANGNLIAPWY | AFALSRGFGS | GIITSNASMD | ECDAKCQTPQ | 300 |
| 19. | SGRMNYYWTL | LEPGDTIIFE | ATGNLIAPKY | AFALSRGPGS | GIITSNAPLD | ECDTKCQTPQ | 299 |
| 20. | AGRINYYWTL | LEPGDTIIFE | ANGNLIAPWH | AFALSRGFGS | GIITSNASMD | ECDTKCQTPQ | 300 |
| 21. | AGRINYYWTL | LEPGDTIIFE | ANGNLIAPWY | AFALSRDFGS | GIITSNASMD | ECDTKCQTPQ | 300 |
| 22. | AGRINYYWTL | LEPGDTIIFE | ANGNLIAPWY | AFALNRGIGS | GIITSNASMD | ECDTKCQTPQ | 300 |
| 23. | AGRMNYYWTL | LEPGDTIIFE | ANGNLIAPWY | AFALSRGFGS | GIITSNASMH | ECDTKCQTPQ | 300 |
| 24. | AGRINYYWTL | LKPGDTIMFE | ANGNLIAPWY | AFALSRGFGS | GIITSNASMH | ECDTKCQTPQ | 299 |
| 25. | AGRMNYYWTL | LEPGDTIIFE | ANGNLIAPKY | AFALSRGFGS | GIITSNASMH | ECNTKCQTPQ | 300 |
| 26. | AGRMNYYWTL | LKPGDTIIFE | ANGNLIAPMY | AFALRRGFGS | GI1TSNASMH | ECNTKCQTPL | 299 |
| 27. | HGRMNYYWTL | LEPGDTIIFE | ATGNLIAPWY | AFALSRGFES | GIITSNASMH | ECNTKCQTPQ | 299 |
| 28. | AGRMNYYWTL | LEPGDTITFE | ATGNLIAPWY | AFALNRGSGS | GIITSDAPVH | DCHTKCQTPH | 300 |
| | **:****** ::***.* ** *.***:.* . ***: *. * *** *:..: .*::.**** | | | | | | |
| 1. | GAINSSLPFQ | NVHPVTIGEC | PKYVRSAKLR | MVTGLRNIPS | IQSRGLFGAI | AGFIEGGWTG | 359 |
| 2. | GAINSSLPFQ | NVHPVTIGEC | PKYVRSAKLR | MVTGLRNIPS | IQSRGLFGAI | AGFIEGGWTG | 359 |
| 3. | GAINSSLPFQ | NVHPVTIGEC | PKYVRSAKLR | MVTGLRNIPS | IQSRGLFGAI | AGFIEGGWTG | 359 |
| 4. | GAINTSLPFQ | NIKPITIGKC | PKYVKSTKLR | LATGLRNIPS | IQSRGLFGAI | AGFIEGGWTG | 360 |
| 5. | GALKNNLPLQ | NVHLFTIGEC | PKYVKSTQLR | MATGLRNIPS | IQSRGLFGAI | AGFIEGGRTG | 360 |
| 6. | GALKSNLPFQ | NVHPSTIGEC | PKYVKSTQLR | MATGLRNIPS | IQSRGLFGAI | AGFIEGGWTG | 360 |
| 7. | GAINSSLPFQ | NVHPVTIGEC | PKYVRSAKLR | MVTGLRNIPS | IQSRGLFGAI | AGFIEGGWTG | 359 |
| 8. | GAINSSLPFQ | NVHPVTIGEC | PKYVRSAKLR | MVTGLRNIPS | IQSRGLFGAI | AGFIEGGWTG | 359 |
| 9. | GAINSSLPFQ | NVHPVTIGEC | PKYVRSTKLR | MVTGLRNVPS | IQSRGLFGAI | AGFIEGGWTG | 360 |
| 10. | GAINSSLPFQ | NVHPVTIGEC | PKYVRSTKLR | MVTGLRNIPS | IQSRGLFGAI | AGFIEGGWTG | 360 |
| 11. | GAINSSLPFQ | NVHPVTIGEC | PKYVRSTKLR | MVTGLRNIPS | IQSRGLFGAI | AGFIEGGWTG | 359 |
| 12. | GAINSSLPFQ | NVHPVTIGEC | PKYVRSTKLR | MVTGLRNIPS | IQSRGLFGAI | AGFIEGGWTG | 360 |
| 13. | GAINSSLPFQ | NVHPVTIGEC | PKYVRSTKLR | MVTGLRNIPS | IQSRGLFGAI | AGFIEGGWTG | 360 |
| 14. | GAINSSLPFQ | NVHPVTIGEC | PKYVRSTKLR | MVTGLRNIPS | IQSRGLFGAI | AGFIEGGWTG | 360 |
| 15. | GAINSSLPFQ | NVHPVTIGEC | PKYVRSTKLR | MVTGLRNIPS | IQSRGLFGAI | AGFIEGGWTG | 360 |
| 16. | GAINSSLPFQ | NVHPVTIGEC | PKYVRSTKLR | MVTGLRNIPS | IQSRGLFGAI | AGFIEGGWTG | 360 |
| 17. | GAINSSLPFQ | NIHPVTIGEC | PKYVRSTKLR | MVTGLRNIPS | IQSRGLFGAI | AGFIEGGWTG | 360 |
| 18. | GAINSSLPFQ | NVHPVTIGEC | PKYVRSTKLR | MVTGLRNIPS | IQSRGLFGAI | AGFIEGGWTG | 360 |
| 19. | GAINSSLPFQ | NIHPVTIGEC | PKYVRSTKLR | MVTGLRNIPS | VQSRGLFGAI | AGFIEGGWTG | 359 |
| 20. | GAINSSLPFQ | NIHPVTIGEC | PKYVRSTKLR | MVTGLRNIPS | IQSRGLFGAI | AGFIEGGWTG | 360 |
| 21. | GAINSSLPFQ | NIHPVTIGEC | PKYVKSTKLR | MVTGLRNIPS | IQSRGLFGAI | AGFIEGGWTG | 360 |
| 22. | GAINSSLPFQ | NIHPFTIGEC | PKYVRSTKLR | MVTGLRNIPS | IQSRGLFGAI | AGFIEGGWDG | 360 |
| 23. | GAINSSLPFQ | NIHPVTIGEC | PKYVRSTKLR | MVTGLRNIPS | IQSRGLFGAI | AGFIEGGWTG | 360 |
| 24. | GAINSSLPFQ | NIHPVTIGEC | PKYVRSTKLR | MVTGLRNIPS | IQSRGLFGAI | AGFIEGGWTG | 359 |

TABLE 2-continued

Sequence alignment of H1 sequences according to particular embodiments of the invention

```
25.  GAINSSLPFQ NIHPVTIGEC PKYVRSTKLR MVTGLRNIPS IQSRGLFGAI AGFIEGGWTG   360
26.  GAIHSSLPYQ NIHPVTIGEC PKYVRSAKLR MVTGLRNIPS IQSRGLFGAI AGFIEGGWTG   359
27.  GSINSNLPFQ NIHPVTIGEC PKYVRSTKLR MVTGLRNIPS IQYRGLFGAI AGFIEGGWTG   359
28.  GAINSSLPFQ NIHPVTIGEC PKYVRSTKLR MATGLRNIPS IQSRGLFGAI AGFIEGGWTG   360
     *:**:.**:* *:**.***:* ****:*:*** :.*****:** :* ******* ******** *

1.  MVDGWYGYHH QNEQGSGYAA DQKSTQNAIN GITNKVNSVI EKMNTQFTAV GKEFNKLERR   419
 2.  MVDGWYGYHH QNEQGSGYAA DQKSTQNAIN GITNKVNSVI EKMNTQFTAV GKEFNKLERR   419
 3.  MVDGWYGYHH QNEQGSGYAA DQKSTQNAIN GITNKVNSVI EKMNTQFTAV GKEFNKLERR   419
 4.  MVDGWYGYHH QNEQGSGYAA DLKSTQNAID EITNKVNSVI EKMNTQFTAV GKEFNHLEKR   420
 5.  MIDGWYGYHH QNEQGSGYAA DQKSTQIAID GINNKANSVI GKMNIQLTSV GKEFNSLEKR   420
 6.  MIDGWYGYHH QNEQGSGYAA DQKSTQIAID GINNKVNSII EKMNTQFTSV GKEFNDLEKR   420
 7.  MVDGWYGYHH QNEQGSGYAA DQKSTQNAIN GITNKVNSVI EKMNTQFTAV GKEFNKLERR   419
 8.  MVDGWYGYHH QNEQGSGYAA DQKSTQNAIN GITNKVNSVI EKMNTQFTAV GKEFNKLERR   419
 9.  MIDGWYGYHH QNEQGSGYAA DQKSTQNAIN GITNKVNSII EKMNTQFTAV GKEFNKLEKR   420
10.  MIDGWYGYHH QNEQGSGYAA DQKSTQNAID GITNKVNSVI EKMNTQFTAV GKEFNKLERR   420
11.  MMDGWYGYHH QNEQGSGYAA DQKSTQNAIN GITNKVNSVI EKMNTQFTAV GKEFNKLERR   419
12.  MIDGWYGYHH QNEQGSGYAA DQKSTQNAIN GITNKVNSVI EKMNTQFTAV GKEFNKLERR   420
13.  MIDGWYGYHH QNEQGSGYAA DQKSTQNAIN GITNKVNSVI EKMNTQFTAV GKEFNKLERR   420
14.  MIDGWYGYHH QNEQGSGYAA DQKSTQNAIN GITNKVNSII EKMNTQFTAV GKEFNKLEKR   420
15.  MIDGWYGYHH QNEQGSGYAA DQKSTQNAIN GITNKVNSVI EKMNTQFTAV GKEFNKLEKR   420
16.  MIDGWYGYHH QNEQGSGYAA DQKSTQNAIN GITNKVNSVI EKMNTQFTAV GKEFNKLEKR   420
17.  MIDGWYGYHH QNEQGSGYAA DQKSTQNAIN GITNKVNSVI EKMNTQFTAV GKEFNKLEKR   420
18.  MIDGWYGYHH QNEQGSGYAA DQKSTQNAIN GITNKVNSVI EKMNTQFTAV GKEFNKLERR   420
19.  MMDGWYGYHH QNEQGSGYAA DQKSTQNAIN GITNKVNSVI EKMNTQFTAV GKEFNKLEKR   419
20.  MIDGWYGYHH QNEQGSGYAA DQKSTQNAIN GITNKVNSVI EKMNTQFTAV GKEFNKLEKR   420
21.  MIDGWYGYHH QNEQGSGYAA DQKSTQNAIN WITNKVNSVI EKMNTQFTAV GKEFNKLEKR   420
22.  MIDGWYGYHH QNEQGSGYAA DQKSTQNAIN GITNKVNSVI EKMNTQFTAV GKEFNKLEKR   420
23.  MIDGWYGYHH QNEQGSGYAA DQKSTQNAIN GITNKVNSVI EKMNTQFTAV GKEFNNLEKR   420
24.  MIDGWYGYHH QNEQGSGYAA DQKSTQNAIN GITNKVNSVI EKMNTQFTAV GKEFNNLEKR   419
25.  MIDGWYGYHH QNEQGSGYAA DQKSTQNAIN GITNKVNSVI EKMNTQFTAV GKEFNNLEKR   420
26.  MIDGWYGYHH QNEQGSGYAA DQKSTQNAIN GITNKVNSVI EKMNIQFTAV GKEFNKLEKR   419
27.  MIDGWYGYHH QNEQGSGYAA DQKSTQNAIN GITNKVNSVI EKMNTQFTAV GKEFNNLEKR   419
28.  MIDGWYGYHH QNEQGSGYAA DQKSTQNAID GITNKVNSVI EKMNTQFTAV GKEFNNLERR   420
     *:******** ********** * *******:  *******:* **** ***** *****:**:*

1.  MENLNKKVDD GFIDIWTYNA ELLVLLENER TLDFHDSNVK NLYEKVKSQL KNNAKEIGNG   479
 2.  MENLNKKVDD GFIDIWTYNA ELLVLLENER TLDFHDSNVK NLYEKVKSQL KNNAKEIGNG   479
 3.  MENLNKKVDD GFLDIWTYNA ELLVLLENER TLDFHDSNVK NLYEKVKSQL KNNAKEIGNG   479
 4.  IENLNKKVDD GFLDIWTYNA ELLVLLENER TLDYHDSNVK NLYEKVRSQL KNNAKEIGNG   480
 5.  KENLNKTVDD RFLDVWTFNA ELLVLLENQR TLEFHDLNIK SLYEKVKSHL RNNDKEIGNG   480
 6.  IENLNKKVDD GFLDVWTYNA ELLILLENER TLDFHDFNVK NLYEKVKSQL RNNAKEIGNG   480
 7.  MENLNKKVDD GFLDIWTYNA ELLVLLENER TLDFHDSNVK NLYEKVKSQL KNNAKEIGNG   479
 8.  MENLNKKVDD GFIDIWTYNA ELLVLLENER TLDFHDSNVK NLYEKVKSQL KNNAKEIGNG   479
 9.  MENLNKKVDD GFLDIWTYNA ELLVLLENER TLDFHDLNVK NLYEKVKNQL KNNAKEIGNG   480
10.  MENLNKKVDD GFLDIWTYNA ELLVLLENER TLDFHDSNVK NLYEKVKTQL KNNAKEIGNG   430
11.  MENLNKKVDD GFLDIWTYNA ELLVLLENER TLDFHDSNVK NLYEKVKSQL KNNAKEIGNG   479
12.  MENLNKKVDD GFLDIWTYNA ELLVLLENGR TLDFHDSNVK NLYEKVKSQL KNNAKEIGNG   480
13.  MENLNKKVDD GFLDIWTYNA ELLVLLENER TLDFHDSNVK NLYEKVKSQL KNNAKEIGNG   480
14.  MENLNKKVDD GFLDIWTYNA ELLVLLENER TLDFHDSNVK NLYEKVKSQL KNNAKEIGNG   480
15.  MENLNKKVDD GFLDIWTYNA ELLVLLENER TLDFHDSNVK NLYEKVKSQL KNNAKEIGNG   480
16.  MENLNKKVDD GFLDIWTYNA ELLVLLENER TLDFHDSNVK NLYEKVKSQL KNNAKEIGNG   480
17.  MENLNKKVDD GFLDIWTYNA ELLVLLENER TLDFHDSNVK NLYEKVKSQL KNNAKEIGNG   480
18.  MENLNKKVDD GFLDIWTYNA ELLVLLENER TLDFHDSNVK NLYEKVKSQL KNNAKEIGNG   480
19.  MENLNKKVDD GFKDIWTYNA ELLVLLENER TLDFHDSNVK NLYEKVKNQL RNNAKELCNC   479
20.  MENLNKKVDD GFLDIWTYNA ELLVLLENER TLDFHDSNVK NLYEKVKSQL KNNAKEIGNG   480
21.  MENLNKKVDD GFLDIWTYNA ELLVLLENER TLDFHDSNVK NLYEKVKNQL RNNAKEIGNG   480
22.  MENLNKKVDD GFLDIWTYNA ELLVLLENER TLDFHDSNVK NLYEKVKNQL RNNAKEIGNG   480
23.  MENLNKKVDD GFLDIWTYNA ELLILLENER TLDFHDSNVK NLYEKVKSQL RNNAKEIGNG   480
24.  MENLNKKVDD GFLDIWTYNA ELLVLLENER TLDFHDSNVK NLYEKVKNQL RNNAKEIGNG   479
25.  MENLNKKVDD GFLDIWTYNA ELLVLLENER TLDFHDSNVK NLYEKVKSQL RNNAKEIGNG   480
26.  MENLNNKVDD GFLDIWTYNA ELLVLLENER TLDFHDSNVK NLYEKVKSQL KNNAKEIGNG   479
27.  MENLNKKVDD GFLDIWTYNA ELLVLLENER TLDFHDLNVK NLYEKVKSQL KNNAKEIGNG   479
28.  IENLNKKVDD GFLDIWTYNA ELLVLLENER TLDFHDSNVR NLYEKVKSQL KNNAKEIGNG   480
     :****:**** **:******* ***:**** * ***:** **: ******:.** :*****:***

1.  CFEFYHKCND ECMESVKNGT YDYPKYSEES KLNREKIDGV KLESMGVYQI IAIYSTVASS   539
 2.  CFEFYHKCND ECKESVKNGT YDYPKYSEES KLNREKIDGV KLESMGVYQI IAIYSTVASS   539
 3.  CFEFYHKCNN ECMESVKNGT YDYPKYSEES KLNREKIDGV KLESMGVYQI LAIYSTVASS   539
 4.  CFEFYHKCDN TCMESVKNGT YDYPKYSEEA KLNREEIDGV KLESTRIYQI LAIYSTVASS   540
 5.  CFEFYHKRDN ECLECVKNGT YNYPKYSEES KFNREEIVGV KLESMGIHQI LAIYSTVASS   540
 6.  CFEFYHKCDN ECMESVKNGT YNYPKYSEES KLNREKIDGV KLESMGVHQI LAIYSTVASS   540
 7.  CFEFYHKCND ECMESVKNGT YDYPKYSEES KLNRERIDGV KLESMGVYQI LAIYSTVASS   539
 8.  CFEFYHKCND ECMESVKNGT YDYPKYSEES KLNREKIDGV KLESMGVYQI LAIYSTVASS   539
 9.  CFEFYHKCNN ECMESVKNGT YDYPKYSKES KLNREKIDGV KLESMGVYQI LAIYSTVASS   540
10.  CFEFYHKCNN ECMESVKNGT YDYPKYSEES KLNREKIDGV KLESMGVYQI LAIYSTVASS   540
11.  CFEFYHKCNN ECMESVKNGT YDYPKYSEES KLNREKIDGV KLESMGVYQI LAIYSTVASS   539
```

TABLE 2-continued

Sequence alignment of H1 sequences according to particular embodiments of the inv TABLE 3-continued Polypeptides expressed in *P. pastoris*.
Expression and CR6261 binding were determined as described and the ratio of binding and expression signals calculated

| | | | | fold increase of ratio over | Fusion peptide area | | | | | B-loop | | | |
|---|---|---|---|---|---|---|---|---|---|---|---|---|---|
| | | | | | | | | | | | 406 | 409 | 413 | 416 |
| SET1 clone | CR6261 binding signal | HTRF signal | ratio | parental H1 mini-HA | 337 E, I, K, V | 340 I, K, R, T | 352 D, F, V, Y | 353 I, K, R, T | 402 E, K M, V | F, I, N, S, T, Y | A, G, I, R, T, V | F, I, N, S, T, Y | H, I, L, N, R, S |
| 233F11 | 583024 | 14389 | 40.52 | 6.82 | K | K | Y | T | M | T | I | G | S |
| 234C5 | 277864 | 9465 | 39.92 | 6.72 | I | I | Y | T | M | F | T | N | L |
| 115A1 | 1176904 | 30389 | 38.73 | 6.52 | K | K | Y | T | M | I | V | Y | I |
| 185G7 | 505864 | 13560 | 37.31 | 6.28 | K | K | Y | T | M | I | V | I | S |
| 275D4 | 327344 | 9030 | 36.25 | 6.10 | K | K | Y | T | M | T | T | S | S |
| 244B8 | 273744 | 7757 | 35.29 | 5.94 | I | T | Y | T | M | Y | A | I | S |
| 252B8 | 284984 | 8252 | 34.54 | 5.81 | K | I | Y | T | M | S | I | N | L |
| 213C11 | 667024 | 20624 | 32.34 | 5.44 | V | K | Y | T | M | I | V | F | H |
| 174G3 | 491184 | 15320 | 32.06 | 5.40 | K | T | Y | K | V | S | G | Y | L |
| 125D10 | 133904 | 4241 | 31.57 | 5.31 | K | I | Y | T | M | Y | V | N | R |
| 127A7 | 233064 | 7498 | 31.08 | 5.23 | E | T | Y | T | M | I | I | I | L |
| 304G11 | 110504 | 3588 | 30.8 | 5.19 | K | K | Y | K | M | F | T | F | S |
| 162A11 | 364024 | 11939 | 30.49 | 5.13 | V | K | Y | T | M | F | A | F | I |
| 271F10 | 315304 | 10348 | 30.47 | 5.13 | I | K | Y | T | M | I | A | I | L |
| 218G11 | 958504 | 33710 | 28.43 | 4.79 | I | T | Y | I | M | I | I | I | N |
| 251C8 | 269544 | 9634 | 27.98 | 4.71 | K | T | Y | K | M | Y | I | N | L |
| 258A6 | 165624 | 6004 | 27.59 | 4.64 | I | T | Y | T | M | Y | T | F | H |
| 134A4 | 456304 | 17366 | 26.28 | 4.42 | K | I | Y | I | M | I | A | Y | N |
| 214C11 | 317904 | 12120 | 26.23 | 4.42 | E | I | Y | T | M | Y | V | S | S |
| 182G8 | 399864 | 15262 | 26.2 | 4.41 | K | K | Y | T | M | T | V | I | I |
| 113E7 | 966064 | 38018 | 25.41 | 4.28 | K | K | F | T | M | Y | T | I | H |
| 230G9 | 854584 | 34093 | 25.07 | 4.22 | K | K | Y | T | M | Y | T | F | R |
| 222G4 | 419064 | 16996 | 24.66 | 4.15 | K | T | F | I | V | I | I | Y | L |
| 18207 | 418944 | 17096 | 24.51 | 4.13 | I | T | Y | T | M | I | I | F | N |
| 272H2 | 263264 | 10844 | 24.28 | 4.09 | K | T | Y | T | M | S | A | N | H |
| 191C8 | 309064 | 12753 | 24.23 | 4.08 | I | T | Y | T | V | I | A | F | I |
| 123C10 | 237824 | 9843 | 24.16 | 4.07 | K | I | Y | K | M | F | A | T | L |
| 284B9 | 1663504 | 70812 | 23.49 | 3.95 | K | T | Y | R | M | I | R | T | L |
| 134A3 | 531784 | 23414 | 22.71 | 3.82 | K | K | F | I | M | I | I | N | S |
| 188F4 | 287384 | 12888 | 22.3 | 3.75 | K | K | Y | T | M | S | V | T | H |
| 18987 | 336344 | 15207 | 22.12 | 3.72 | E | T | F | T | M | Y | V | F | N |
| 148D5 | 329144 | 14994 | 21.95 | 3.70 | E | T | Y | I | M | F | G | S | H |
| 194C8 | 242304 | 11113 | 21.8 | 3.67 | I | T | F | T | M | F | V | F | I |
| 188A8 | 279144 | 13001 | 21.47 | 3.61 | K | T | Y | K | M | F | V | S | I |
| 162B3 | 279584 | 13159 | 21.25 | 3.58 | V | T | Y | T | M | Y | T | N | N |
| 204C5 | 832784 | 39330 | 21.17 | 3.56 | V | K | F | T | V | I | I | Y | L |
| 216E5 | 334904 | 15873 | 21.1 | 3.55 | V | T | F | T | M | F | R | Y | R |
| 129C2 | 199464 | 9486 | 21.03 | 3.54 | V | R | Y | I | M | I | I | Y | S |
| 286E8 | 158704 | 7662 | 20.71 | 3.49 | E | I | F | T | M | F | I | Y | S |
| 264G4 | 180504 | 8751 | 20.63 | 3.47 | K | R | Y | T | V | I | V | F | S |
| 214C4 | 302264 | 14709 | 20.55 | 3.46 | I | I | F | T | V | F | A | S | S |
| 125A8 | 212224 | 10327 | 20.55 | 3.46 | K | I | F | T | V | I | V | Y | I |
| 123G2 | 498584 | 24442 | 20.4 | 3.43 | I | T | Y | I | M | Y | T | F | L |
| 187C6 | 345464 | 16932 | 20.4 | 3.43 | E | K | Y | K | M | F | I | I | H |
| 134H10 | 591704 | 29253 | 20.23 | 3.41 | K | T | Y | T | V | I | T | F | I |
| 187H10 | 299224 | 15289 | 19.57 | 3.29 | K | T | Y | I | M | I | G | F | L |
| 101D4 | 336584 | 17243 | 19.52 | 3.29 | I | K | Y | I | M | I | I | S | N |
| 193B6 | 206904 | 10650 | 19.43 | 3.27 | K | K | Y | R | M | F | I | S | N |
| 137C5 | 295944 | 15406 | 19.21 | 3.23 | I | R | F | T | V | I | I | N | N |
| 112F3 | 449824 | 24169 | 18.61 | 3.13 | V | R | F | I | M | I | I | Y | S |
| 176A5 | 193104 | 10476 | 18.43 | 3.10 | I | T | F | T | V | F | I | F | I |
| 213B2 | 131704 | 7178 | 18.35 | 3.09 | K | K | Y | T | M | T | V | F | L |
| 307A10 | 114984 | 6348 | 18.11 | 3.05 | I | K | F | T | M | Y | G | Y | H |
| 126C3 | 219944 | 12413 | 17.72 | 2.98 | E | T | F | I | M | F | G | T | I |
| 263B6 | 151184 | 8800 | 17.18 | 2.89 | I | T | Y | I | M | S | T | Y | I |
| 138F11 | 147864 | 8788 | 16.83 | 2.83 | E | R | Y | R | M | F | V | F | L |
| 134D3 | 303504 | 18129 | 16.74 | 2.82 | E | R | F | I | M | Y | T | F | S |
| 131D5 | 344504 | 20857 | 16.52 | 2.78 | V | T | Y | I | V | I | A | F | S |
| 138F8 | 347704 | 21081 | 16.49 | 2.78 | K | T | Y | I | M | Y | A | F | H |
| 301F11 | 116904 | 7108 | 16.45 | 2.77 | V | T | F | T | V | Y | I | S | H |
| 112G6 | 543944 | 33149 | 16.41 | 2.76 | V | R | Y | I | M | F | I | S | I |
| 245C9 | 180024 | 10980 | 16.4 | 2.76 | V | R | F | T | V | F | V | T | L |
| 123E2 | 477064 | 29184 | 16.35 | 2.75 | V | T | Y | T | V | F | V | F | S |
| 266A11 | 90584 | 5696 | 15.9 | 2.68 | V | T | Y | T | M | Y | I | T | R |
| 104C4 | 521224 | 34458 | 15.13 | 2.55 | V | K | Y | I | M | F | G | F | N |
| 194E4 | 408584 | 27424 | 14.9 | 2.51 | E | K | F | T | M | I | T | F | I |
| 206B11 | 358744 | 24697 | 14.53 | 2.45 | V | R | Y | T | M | F | T | I | L |
| 192C4 | 343184 | 23932 | 14.34 | 2.41 | K | T | Y | K | M | I | V | T | N |

TABLE 3-continued

Polypeptides expressed in *P. pastoris*.
Expression and CR6261 binding were determined as described and the ratio of binding and expression signals calculated

| SET1 clone | CR6261 binding signal | HTRF signal | ratio | fold increase of ratio over parental H1 mini-HA | Fusion peptide area | | | | 402 E, K M, V | B-loop | | | |
|---|---|---|---|---|---|---|---|---|---|---|---|---|---|
| | | | | | 337 E, I, K, V | 340 I, K, R, T | 352 D, F, V, Y | 353 I, K, R, T | | 406 F, I, N, S, T, Y | 409 A, G, I, R, T, V | 413 F, I, N, S, T, Y | 416 H, I, L, N, R, S |
| 125H3 | 317384 | 22785 | 13.93 | 2.35 | I | T | F | T | M | I | A | Y | R |
| 145C9 | 182344 | 13108 | 13.91 | 2.34 | I | T | F | I | V | Y | I | S | N |
| 243D6 | 132144 | 9596 | 13.77 | 2.32

TABLE 4-continued

Polypeptides expressed in *P. pastoris*.
Expression and CR6261 binding were determined as described and the ratio of binding and expression signals calculated.

| | | | | | Fusion peptide area | | | | B-loop | | | | |
|---|---|---|---|---|---|---|---|---|---|---|---|---|---|
| Set 2 clone | CR6261 binding signal | HTRF signal | ratio | fold increase of ratio over parental SEQ ID NO: 6 | 337 A, E, I, K, T, V | 340 F, I, N, S, T, Y | 352 A, D, F, I, N, S, T, V, Y | 353 E, G, I, K, R, V | 402 M, R, T | 406 F, H, L, Y | 409 F, I, S, T | 413 E, K, M, V | 416 I, L, R, S |
| 9C6 | 270984 | 8235 | 32.91 | 5.54 | K | T | Y | V | M | Y | T | K | I |
| 81F11 | 317824 | 9964 | 31.9 | 5.37 | K | I | F | V | M | F | F | V | S |
| 84E10 | 255064 | 7996 | 31.9 | 5.37 | I | N | F | R | M | F | S | V | S |
| 71C4 | 1350144 | 44339 | 30.45 | 5.13 | K | N | F | G | M | F | I | V | S |
| 84D3 | 84424 | 2920 | 28.91 | 4.87 | E | N | F | K | M | L | I | E | S |
| 96H8 | 205904 | 7224 | 28.5 | 4.80 | K | Y | Y | K | M | F | I | M | S |
| 85A7 | 235704 | 8416 | 28.01 | 4.72 | K | N | Y | E | M | L | F | V | R |
| 50G10 | 264144 | 9470 | 27.89 | 4.70 | T | N | F | E | M | F | F | V | S |
| 6A1 | 299824 | 10912 | 27.48 | 4.63 | A | N | F | H | M | F | F | M | S |
| 91C4 | 1157424 | 44837 | 25.81 | 4.35 | K | N | F | G | M | L | I | M | R |
| 2C4 | 258264 | 10139 | 25.47 | 4.29 | I | N | F | V | M | F | I | V | L |
| 63C3 | 188184 | 7625 | 24.68 | 4.15 | E | T | Y | K | M | L | F | V | L |
| 850 | 196024 | 8115 | 24.16 | 4.07 | K | N | V | G | M | F | F | V | I |
| 67C10 | 306104 | 12907 | 23.72 | 3.99 | E | T | F | V | M | F | F | M | L |
| 10F9 | 165984 | 7113 | 23.34 | 3.93 | I | I | Y | V | M | Y | F | E | R |
| 4C1 | 385504 | 16548 | 23.3 | 3.92 | K | N | S | V | M | F | I | E | I |
| 86G3 | 183944 | 7995 | 23.01 | 3.87 | T | S | Y | V | M | F | T | V | L |
| 51G10 | 215264 | 9727 | 22.13 | 3.73 | A | N | Y | R | M | F | I | K | S |
| 58A5 | 90744 | 4142 | 21.91 | 3.69 | V | T | F | R | M | L | I | M | S |
| 56F8 | 235344 | 10823 | 21.74 | 3.66 | I | N | F | E | M | F | T | E | L |
| 67C11 | 209184 | 9856 | 21.22 | 3.57 | K | Y | Y | I | M | F | F | E | I |
| 91C8 | 333584 | 16012 | 20.83 | 3.51 | K | N | F | G | M | L | I | K | S |
| 48811 | 302864 | 14946 | 20.26 | 3.41 | I | N | A | G | M | L | I | E | S |
| 78F11 | 84104 | 4155 | 20.24 | 3.41 | I | I | F | R | M | Y | F | E | I |
| 76A10 | 136984 | 6841 | 20.02 | 3.37 | I | Y | F | V | M | Y | F | E | I |
| 55H2 | 58104 | 2984 | 19.47 | 3.28 | I | I | Y | V | M | F | F | V | S |
| 74D7 | 358784 | 18453 | 19.44 | 3.27 | K | N | A | G | M | F | I | M | S |
| 11B4 | 166464 | 8679 | 19.18 | 3.23 | T | S | F | V | M | Y | T | V | S |
| 56F4 | 185984 | 9740 | 19.09 | 3.21 | T | T | F | E | M | F | S | M | S |
| 71E7 | 202704 | 10688 | 18.97 | 3.19 | K | N | S | R | M | Y | I | E | S |
| 48B10 | 102904 | 5480 | 18.78 | 3.16 | I | F | F | K | M | L | F | M | S |
| 48D11 | 120584 | 6807 | 17.71 | 2.98 | E | Y | Y | V | M | F | T | V | S |
| 35H3 | 106224 | 6092 | 17.44 | 2.94 | V | S | F | V | M | L | S | M | R |
| 53G10 | 107784 | 6188 | 17.42 | 2.93 | T | N | F | V | M | L | T | V | S |
| 86F1 | 158624 | 9145 | 17.35 | 2.92 | I | I | F | V | M | Y | I | V | I |
| 9C10 | 114144 | 6595 | 17.31 | 2.91 | I | I | Y | V | M | H | S | V | S |
| 6E12 | 372504 | 22044 | 16.9 | 2.85 | E | N | F | I | M | L | F | V | L |
| 2D9 | 316024 | 19245 | 16.42 | 2.76 | K | N | N | I | M | Y | F | E | L |
| 27B10 | 187344 | 11465 | 16.34 | 2.75 | K | N | N | V | M | L | F | E | S |
| 79F8 | 185264 | 11801 | 15.7 | 2.64 | I | N | V | I | M | F | T | E | S |
| 11F4 | 150824 | 9996 | 15.09 | 2.54 | I | Y | F | V | M | Y | F | V | L |
| 60A2 | 92664 | 6166 | 15.03 | 2.53 | E | N | Y | V | M | F | S | E | L |
| 58C8 | 277144 | 18603 | 14.9 | 2.51 | A | S | Y | I | M | L | S | E | L |
| 12C6 | 289184 | 20023 | 14.44 | 2.43 | I | N | S | V | M | L | I | E | L |
| 89F11 | 84824 | 5908 | 14.36 | 2.42 | T | I | Y | I | M | L | S | V | S |
| 96G5 | 108264 | 7589 | 14.27 | 2.40 | V | N | F | I | M | Y | F | M | S |
| 29C2 | 177904 | 12921 | 13.77 | 2.32 | K | N | F | G | M | Y | F | M | R |
| 56D2 | 145624 | 10658 | 13.66 | 2.30 | E | T | F | I | M | F | F | K | S |
| 66C8 | 184544 | 13591 | 13.58 | 2.29 | K | N | V | I | M | L | F | V | L |
| 69D2 | 445704 | 34266 | 13.01 | 2.19 | V | F | F | V | M | Y | T | E | S |
| 75E9 | 134504 | 10422 | 12.91 | 2.17 | I | I | F | G | M | F | S | E | I |
| 97G10 | 253104 | 20061 | 12.62 | 2.12 | E | S | F | I | M | F | F | E | I |
| 36E4 | 196104 | 15917 | 12.32 | 2.07 | I | N | N | K | M | F | F | V | L |
| 7D9 | 77824 | 6320 | 12.31 | 2.07 | K | N | F | V | M | F | F | M | L |
| 1F2 | 148544 | 12244 | 12.13 | 2.04 | K | N | Y | V | M | F | F | M | I |
| 76D10 | 113664 | 9729 | 11.68 | 1.97 | T | N | A | K | M | L | T | E | S |
| 36H2 | 171144 | 14761 | 11.59 | 1.95 | T | N | Y | K | M | H | F | M | R |
| 86G2 | 69704 | 6069 | 11.49 | 1.93 | E | N | F | V | M | L | I | E | R |
| 63D3 | 145784 | 13100 | 11.13 | 1.87 | K | N | I | G | M | F | T | E | L |
| 96A7 | 83304 | 7575 | 11 | 1.85 | V | I | F | V | M | F | S | V | S |
| 36D6 | 71304 | 6569 | 10.85 | 1.83 | I | N | A | G | M | F | T | E | I |

TABLE 4-continued

Polypeptides expressed in *P. pastoris*.
Expression and CR6261 binding were determined as described and the ratio of binding and expression signals calculated.

| | | | | | Fusion peptide area | | | | | | | | |
|---|---|---|---|---|---|---|---|---|---|---|---|---|---|
| | | | | | | | 352 A, D, | | | | B-loop | | |
| | | | | fold increase of ratio over | 337 | 340 | F, I, | 353 | | | | | |
| Set 2 clone | CR6261 binding signal | HTRF signal | ratio | parental SEQ ID NO: 6 | A, E, I, K, T, V | F, I, N, S, T, Y | N, S, T, V, Y | E, G, I, K, R, V | 402 M, R, T | 406 F, H, L, Y | 409 F, I, S, T | 413 E, K, M, V | 416 I, L, R, S |
| 91F10 | 14784 | 1394 | 10.6 | 1.78 | T | N | Y | G | M | F | I | E | R |
| 80F10 | 90864 | 8609 | 10.55 | 1.78 | I | S | V | V | M | L | I | E | S |
| 75H8 | 103304 | 10074 | 10.25 | 1.73 | A | N | V | N | M | F | F | M | S |
| 57B8 | 58384 | 5800 | 10.07 | 1.70 | K | I | Y | I | M | F | F | V | I |
| 8D7 | 73424 | 7324 | 10.03 | 1.69 | K | N | F | V | M | L | F | F | L |
| 58A11 | 53264 | 5363 | 9.93 | 1.67 | V | T | Y | I | M | F | T | V | S |
| 7B6 | 60384 | 6137 | 9.84 | 1.66 | K | I | S | E | M | F | I | M | S |
| 87H5 | 78104 | 7994 | 9.77 | 1.64 | E | I | F | I | M | F | F | V | S |
| 70F6 | 418624 | 43334 | 9.66 | 1.63 | K | N | I | G | M | L | T | E | R |
| 26H1 | 78774 | 8268 | 9.64 | 1.62 | E | N | F | I | M | L | S | V | I |
| 78G2 | 56704 | 6055 | 9.36 | 1.58 | V | I | Y | G | M | L | F | E | S |
| SEQ ID NO: 6 AV + 25D | | | 9.28 | 1.56 | | | | | | | | | |
| SEQ ID NO | 238077 | 40100 | 5.94 | 1.00 | | | | | | | | | |

TABLE 5

Polypeptides expressed in HEK293F.
Expression and CR6261 binding were determined as described and the ratio of binding and expression signals calculated. The mutations included in each clone are indicated in Table 4 and 5.

| Clone | CR6261 binding signal | HTRF signal | ratio | fold increase of ratio over parental SEQ ID NO: 6 |
|---|---|---|---|---|
| 127H1 | 24150000 | 327363 | 73.77 | 4.25 |
| 86B4 | 19970680 | 334887 | 59.63 | 3.44 |
| 171E5 | 6625080 | 235511 | 28.13 | 1.62 |
| 7A7 | 6191080 | 242461 | 25.53 | 1.47 |
| 71H2 | 21080360 | 336346 | 62.67 | 3.61 |
| 220C9 | 8493560 | 162872 | 52.15 | 3.00 |
| 131B5 | 5725640 | 139561 | 41.03 | 2.36 |
| 115A1 | 9557640 | 175377 | 54.50 | 3.14 |
| 74H9 | 26144240 | 344988 | 75.78 | 4.37 |
| 71C4 | 6413600 | 214495 | 29.90 | 1.72 |
| 91C4 | 8442400 | 245138 | 34.44 | 1.98 |
| 113E7 | 13005960 | 260748 | 49.88 | 2.87 |
| 6E12 | 15326000 | 309443 | 49.53 | 2.85 |
| 181H9 | 11892520 | 324690 | 36.63 | 2.11 |
| SEQ ID NO: 6 AV | 5661550 | 326077 | 17.36 | 1.00 |

TABLE 6

Naturally occuring sequence variation at the indicated positions in % of total number of sequences for each subtype

| Position | amino acid | H1 | H3 | H5 | H7 |
|---|---|---|---|---|---|
| 337 | V | 67 | 99 | 19 | 100 |
| | I | 32 | 1 | 2 | |
| | T | 0.8 | | 3 | |
| | S | | | 73 | |
| | Y | | | 0.1 | |
| | N | | | 0.5 | |
| | A | | | 2 | |
| | G | | | 0.1 | |
| 340 | I | 99 | | 21 | 98 |
| | V | 0.43 | | | |
| | T | 0.03 | 0.

TABLE 8

Molecular weights as determined by SEC-MALS for polypeptides of the invention and their complexes with Fab fragments of CR6261 and CR9114. Theoretical (theor) values are estimated on the basis of the sequence of the polypeptide of the invention (assuming a monomer) and an additional contribution of approximately 10 kDa from attached glycans. The molecular weights of the Fab fragments of CR6261, CR9114 and CR8020 were also determined by SEC-MALS, and were 48, 49 and 47 kDa, respectively.

| | SEQ ID NO: | MW (kDa) | | MW complex with CR6261 (kDa) | | MW complex with CR9114 (kDa) | |
|---|---|---|---|---|---|---|---|
| | | Theor | Observed | Theor | Observed | Theor | Observed |
| s127H1 | 35 | 40 | 39 | 87 | 74 | 86 | 83 |
| s86B4 | 36 | 40 | 40 | 88 | 75 | 87 | 83 |
| s55G7 | 37 | 40 | 40 | 90 | 66 | 87 | 80 |
| s74H9 | 34 | 40 | 41 | 89 | 72 | 88 | 83 |
| s6E12 | 38 | 40 | 40 | 88 | 67 | 87 | 80 |

TABLE 9

Disulfide bridges designed and tested

| Cluster | Cysteines introduced at position |
|---|---|
| 14 | 423 and 424 |
| 15 | 430 and 431 |
| 16 | 404 and 433 |
| 17 | 405 and 429 |
| 18 | 411 and 419 |
| 19 | 38 and 390 |
| 21 | 39 and 393 |
| 22 | 36 and 394 |
| 23 | 342 and 460 |
| 24 | 344 and 467 |
| 25 | 344 and 464 |

TABLE 10

Molecular weights as determined form SEC MALS experiments. Theoretically expected values for trimeric FL or s127H1-t2-cl18 and the trimeric FL or s127H1-t2-cl18 complex with Fab fragments (3 per trimer) are given between brackets

| | Mw (kDa) | | | ***$K_d^{app}$ (nM) | |
|---|---|---|---|---|---|
| | | Trimer protein complex with | | Protein complex with | |
| Construct Name | Trimer | CRF9114 | CRF6261 | CR9114 | CR6261 |
| s127H1-t2-cl18long | 108 (120) | 241 (246) | 216 (255) | 0.5 | 0.5 |

***$K_d^{app}$ calculated from steady state Octet measurements (see FIG. 9)

TABLE 11

Design of interprotomer disulfide bridges for stem domain polypeptides derived from HA of group 2 Influenza strains

| Cluster | Cysteines introduced at position | Remarks |
|---|---|---|
| 14 | 425 and 426 | Numbering refers to the sequence of full length HA from H3N2 A/Hong Kong/1/1968 (SEQ ID NO: 237) |
| 15 | 432 and 433 | |
| 17 | 407 and 431 | |
| 18 | 413 and 421 | |
| 30 | 410 and 428 | |
| 31 | 411 and 428 | |

TABLE 12

Summary of survival proportion data (in %) reported in examples 17-21

| Challenge subtype | Challenge strain | SEQ ID NO: 186 | SEQ ID NO: 254 | SEQ ID NO: 203 | SEQ ID NO: 186* | Example no: |
|---|---|---|---|---|---|---|
| H5N1 | A/HK/156/97 | 100 | | | | 17 (serum transfer) |
| H1N1 | A/Bris/59/07 | | 100 | 100 | 100 | 18 |
| H1N1 | A/NL/602/09 | | 60 | 100 | 70 | 19 |
| H1N1 | A/PR/8/34 | | 100 | 100 | 100 | 21 |
| H5N1 | A/HK/156/97 | | 100 | 100 | 100 | 20 |

Survival % are reported at day 21 post challenge (end of follow-up) and are all significantly different from the negative control group receiving PBS.
*expressed in Sf9 insect cells;

TABLE 13

The protein yield and the EC50 values of purified material in the sandwich ELISA

| Construct | Yield (mg/l culture supernatant) | Antibody | EC50 (µg/ml) |
|---|---|---|---|
| s127H1-t2-cl18long SEQ ID NO: 181 | ~11.1 | CR9114 | 0.026 |
| | | CR6261 | 0.139 |
| Tex_s127H1-t2-cl18 SEQ ID NO: 208 | ~13.7 | CR9114 | 0.045 |
| | | CR6261 | 0.369 |
| NY_s127H1-t2-cl18 SEQ ID NO: 210 | ~2.7 | CR9114 | 0.070 |
| | | CR6261 | 0.455 |

TABLE 14

Characterization of polypeptides of the invention with additional c-terminal trimerization domain.

| Construct SEQ ID NO: | Expression AlphaLISA (counts) | Expression (intensity of trimer band in Western blot) | Multimer ELISA ($Log_{10}EC_{50}$ of supernatant dilution) | CR9114 binding AlphaLISA (counts) | CR6261 binding AlphaLISA (counts) |
|---|---|---|---|---|---|
| 186 | | Very good | 4.43 | 2.71E+05 | 1.55E+05 |
| 255 | 1.38E+06 | Very good | 4.81 | 8.79E+05 | 5.72E+05 |
| 256 | 1.33E+06 | Very good | 4.72 | 7.14E+05 | 4.75E+05 |
| 257 | 1.67E+06 | Very good | 4.86 | 8.61E+05 | 5.87E+05 |
| 258 | 1.54E+06 | Very good | 4.82 | 8.42E+05 | 6.25E+05 |

REFERENCES

Alberini et al. (2009), Vaccine 27: 5998-6003.
Bommakanti et al. (2010), PNAS 107(31): 13701-13706.
Bommakanti et al. (2012), J Virol 86: 13434.
Cheng et al. (2014), J. Immunol. Methods 1-13. (doi: 10.1016/j.jim.2014.07.010)
Coffman et al. (2010), Immunity 33: 492.
Devereux et al. (1984), Nucl. Acids Res. 12: 387.
DiLillo et al. (2014), Nat Med 20, 143.
Dopheide T A, Ward C W. (1981) J Gen Virol. 367-370
Ekiert et al. (2009), Science 324:246.
Ekiert et al. (2011), Science 333: 844.
Ferguson et al. (2003), Nature 422: 428-443.
Lorieau et al. 2010, Proc. Natl. Acad. Sci. USA, 107: 11341.
Lu et al. (2013), www.pnas.org/cgi/doi/10.1073/pnas.1308701110.
Mallajosyula et al. (2014), www.pnas.org/cgi/doi/10.1073/pnas.1402766111.
Parekh et al. (2012), mAbs 4: 310.
Safronetz et al (2011) J Virol. 85:1214
Schnueriger et al. (2011), Molecular immunology 48: 1512.
Steel et al. (2010), mBio 1(1): 1-9.
Steven et al. (2004) Science 303: 1866.
Steven et al. (2006) Science 312: 404.
Temperton et al. (2007) Viruses 1: 105-12.
Throsby et al. (2008), Plos One 12(3): 1-15.
Wilson et al (1981) Nature 289: 366.

| SEQUENCES |
| --- |

```
SEQ ID NO 1: H1 Full length (A/Brisbane/59/2007)
MKVKLLVLLC TFTATYADTI CIGYHANNST DTVDTVLEKN VTVTHSVNLL      50

ENSHNGKLCL LKGIAPLQLG NCSVAGWILG NPECELLISK ESWSYIVEKP     100

NPENGTCYPG HFADYEELRE QLSSVSSFER FEIFPKESSW PNHTVTGVSA     150

SCSHNGESSF YRNLLWLTGK NGLYPNLSKS YANNKEKEVL VLWGVHHPPN     200

IGDQKALYHT ENAYVSVVSS HYSRKFTPEI AKRPKVRDQE GRINYYWTLL     250

EPGDTIIFEA NGNLIAPRYA FALSRGFGSG IINSNAPMDK CDAKCQTPQG     300

AINSSLPFQN VHPVTIGECP KYVRSAKLRM VTGLRNIPSI QSRGLFGAIA     350

GFIEGGWTGM VDGWYGYHHQ NEQGSGYAAD QKSTQNAING ITNKVNSVIE     400

KMNTQFTAVG KEFNKLERRM ENLNKKVDDG FIDIWTYNAE LLVLLENERT     450

LDFHDSNVKN LYEKVKSQLK NNAKEIGNGC FEFYHKCNDE CMESVKNGTY     500

DYPKYSEESK LNREKIDGVK LESMGVYQIL AIYSTVASSL VLLVSLGAIS     550

FWMCSNGSLQ CRICI                                          565

SEQ ID NO: 2: H1-mini2-cluster1 + 5 + 6-GCN4
MKVKLLVLLC TFTATYADTI CIGYHANNST DTVDTVLEKN VTVTHSVNLL      50

ENGGGGKYVC SAKLRMVTGL RNIPSIQSQG LFGAIAGFIE GGWTGMVDGW     100

YGYHHQNEQG SGYAADQKST QNAINGITNK VNSVIEKMNT QSTATGKEGN     150

KSERMKQIED KIEEIESKQI WCYNAELLVL LENERTLDFH DSNVKNLYEK     200

VKSQLKNNAK EIGNGCFEFY HKCNDECMES VKNGTYDYPK YSEESKLNRE     250

KIDGVKLESM GVYQILAIYS TVASSLVLLV SLGAISFWMC SNGSLQCRIC     300

I                                                         301

SEQ ID NO: 3: foldon
GYIPEAPRDGQAYVRKDGEWVLLSTFL

SEQ ID NO: 4: FLAG-thrombin-foldon-HIS
SGRDYKDDDDKLVPRGSPGSGYIPEAPRDGQAYVRKDGEWVLLSTFLGHHHHHH

SEQ ID NO: 5:
MKQIEDKIEEIESKQ

SEQ ID NO: 6: H1-mini2-cluster1 + 5 + 6-GCN4 without leader
sequence and with FLAG-thrombin-foldon-HIS
DTICIGYHANNSTDTVDTVLEKNVTVTHSVNLLENGGGGKYVCSAKLRMVTGLRNIPSIQ

SQGLFGAIAGFIEGGWTGMVDGWYGYHHQNEQGSGYAADQKSTQNAINGITNKVNSVIEK

MNTQSTATGKEGNKSERMKQIEDKIEEIESKQIWCYNAELLVLLENERTLDFHDSNVKNL

YEKVKSQLKNNAKEIGNGCFEFYHKCNDECMESVKNGTYDYPKYSEESKLNREKIDGVSG

RDYKDDDDKLVPRGSPGSGYIPEAPRDGQAYVRKDGEWVLLSTFLGHHHHHH
```

| SEQUENCES |
|---|
| SEQ ID NO 7: H1 consensus sequence residue 402-418<br>(numbering according to SEQ ID NO: 1)<br>402 MNTQFTAVG KEFN(H/K)LE(K/R) 418<br><br>>SC09-114 VH PROTEIN<br>(SEQ ID NO: 11)<br>QVQLVQSGAEVKKPGSSVKVSCKSSGGTSNNYAISWVRQAPGQGLDWMGGISPIFGSTAY<br><br>AQKFQGRVTISADIFSNTAYMELNSLTSEDTAVYFCARHGNYYYYSGMDVWGQGTTVTVS<br><br>S<br><br>>SC09-114 VL PROTEIN<br>(SEQ ID NO: 12)<br>SYVLTQPPAVSGTPGQRVTISCSGSDSNIGRRSVNWYQQFPGTAPKLLIYSNDQRPSVVP<br><br>DRFSGSKSGTSASLAISGLQSEDEAEYYCAAWDDSLKGAVFGGGTQLTVL<br><br>>CR6261 VH PROTEIN<br>(SEQ ID NO: 9)<br>E V Q L V E S G A E V K K P G S S V K V S C K A S G G P F R<br><br>S Y A I S W V R Q A P G Q G P E W M G G I I P I F G T T K Y<br><br>A P K F Q G R V T I T A D D F A G T V Y M E L S S L R S E D<br><br>T A M Y Y C A K H M G Y Q V R E T M D V W G K G T T V T V S<br><br>S<br><br>>CR6261 VL PROTEIN<br>(SEQ ID NO: 10)<br>Q S V L T Q P P S V S A A P G Q K V T I S C S G S S S N I G<br><br>N D Y V S W Y Q Q L P G T A P K L L I Y D K N K R P S G I P<br><br>D R F S G S K S G T S A T L G I T G L Q T G D E A N Y Y C A<br><br>T W D R R P T A Y V V F G G G T K L T V L G<br><br>>SC08-057 VH PROTEIN<br>(SEQ ID NO: 13)<br>EVQLVESGGGLVQPGGSLRLSCAASGFTDSVIFMSWVRQAPGKGLECVSIIYIDDSTYYA<br><br>DSVKGRFTISRHNSMGTVFLEMNSLRPDDTAVYYCATESGDFGDQTGPYHYYAMDV<br><br>>SC08-057 VL PROTEIN<br>(SEQ ID NO: 14)<br>QSALTQPASVSGSPGQSITISCTGSSGDIGGYNAVSWYQHHPGKAPKLMIYEVTSRPSGV<br><br>SDRFSASRSGDTASLTVSGLQAEDEAHYYCCSFADSNILI<br><br>>SC08-020 VH PROTEIN<br>(SEQ ID NO: 17)<br>QVQLQQSGAEVKTPGASVKVSCKASGYTFTRFGVSWIRQAPGQGLEWIGWISAYNGDTYYAQKFQ<br><br>ARVTMTTDTSTTTAYMEMRSLRSDDTAVYYCAREPPLFYSSWSLDN<br><br>>SC08-020 VL PROTEIN<br>(SEQ ID NO: 18)<br>EIVXTQSPGTLSLSPGERATLSCRASQSVSMNYLAWFQQKPGQAPRLLIYGASRRATGIPDRISG<br><br>SGSGTDFTLTISRLEPADFAVYYCQQYGTSPRT<br><br>SEQ ID NO: 51: H1-mini2-cluster1 + 5 + 6-GCN4t2<br>MKVKLLVLLC TFTATYADTI CIGYHANNST DTVDTVLEKN VTVTHSVNLL    50<br><br>ENGGGGKYVC SAKLRMVTGL RNIPSIQSQG LFGAIAGFIE GGWTGMVDGW    100<br><br>*YGYHHQNEQG SGYAADQKST QNAINGITNK VNSVIEKMNT QSTATGKEGN*    150<br><br>*K*SERRMRQIE DKIEEIESK*I WCYNAELLVL LENERTLDFH DSNVKNLYEK*    200<br><br>*VKSQLKNNAK EIGNGCFEFY HKCNDECMES VKNGTYDYPK YSEESKLNRE*    250<br><br>*KIDGVKLESM GVYQILAIYS TVASSLVLLV SLGAISFWMC SNGSLQCRIC*    300 |

SEQUENCES

SEQ ID NO: 52: H1-mini2-cluster1 + 5 + 6-GCN4t3
```
MKVKLLVLLC TFTATYADTI CIGYHANNST DTVDTVLEKN VTVTHSVNLL      50
ENGGGGKYVC SAKLRMVTGL RNIPSIQSQG LFGAIAGFIE GGWTGMVDGW     100
YGYHHQNEQG SGYAADQKST QNAINGITNK VNSVIEKMNT QSTATGKEGN     150
KSRMKQIEDK IEEIESKQKI WCYNAELLVL LENERTLDFH DSNVKNLYEK     200
VKSQLKNNAK EIGNGCFEFY HKCNDECMES VKNGTYDYPK YSEESKLNRE     250
KIDGVKLESM GVYQILAIYS TVASSLVLLV SLGAISFWMC SNGSLQCRIC     300
I                                                          301
```

SEQ ID NO: 55: 127H1
```
MKVKLLVLLCTFTATYADTICIGYHANNSTDTVDTVLEKNVTVTHSVNLLENGGGGKYVCSAKLR
MVTGLRNKPSKQSQGLFGAIAGFTEGGWTGMVDGWYGYHHQNEQGSGYAADQKSTQNAINGITNK
VNSVIEKMNTQYTAIGKEYNKSERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI
```

SEQ ID NO: 56: 86B4
```
MKVKLLVLLCTFTATYADTICIGYHANNSTDTVDTVLEKNVTVTHSVNLLENGGGGKYVCSAKLR
MVTGLRNKPSNQSQGLFGAIAGYKEGGWTGMVDGWYGYHHQNEQGSGYAADQKSTQNAINGITNK
VNSVIEKMNTQFTAIGKEMNKIERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI
```

SEQ ID NO: 57: 74H9
```
MKVKLLVLLCTFTATYADTICIGYHANNSTDTVDTVLEKNVTVTHSVNLLENGGGGKYVCSAKLR
MVTGLRNKPSNQSQGLFGAIAGFKEGGWTGMVDGWYGYHHQNEQGSGYAADQKSTQNAINGITNK
VNSVIEKMNTQYTAFGKEMNKSERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI
```

SEQ ID NO: 58: 6E12
```
MKVKLLVLLCTFTATYADTICIGYHANNSTDTVDTVLEKNVTVTHSVNLLENGGGGKYVCSAKLR
MVTGLRNEPSNQSQGLFGAIAGFIEGGWTGMVDGWYGYHHQNEQGSGYAADQKSTQNAINGITNK
VNSVIEKMNTQLTAFGKEVNKLERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI
```

SEQ ID NO: 59: 55G7
```
MKVKLLVLLCTFTATYADTICIGYHANNSTDTVDTVLEKNVTVTHSVNLLENGGGGKYVCSAKLR
MVTGLRNKPSNQSQGLFGAIAGYVEGGWTGMVDGWYGYHHQNEQGSGYAADQKSTQNAINGITNK
VNSVIEKMNTQYTAIGKEMNKLERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI
```

SEQ ID NO: 60: 115A1
```
MKVKLLVLLCTFTATYADTICIGYHANNSTDTVDTVLEKNVTVTHSVNLLENGGGGKYVCSAKLR
MVTGLRNKPSKQSQGLFGAIAGYTEGGWTGMVDGWYGYHHQNEQGSGYAADQKSTQNAINGITNK
```

| SEQUENCES |
|---|
| VNSVIEKMNTQITAVGKEYNKIERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDG
VKLESMGVYQILAIYSTVASSLVLLVSLGAISFWMCSNGSLQCRICI |
| SEQ ID NO: 61: 71H2
MKVKLLVLLCTFTATYADTICIGYHANNSTDTVDTVLEKNVTVTHSVNLLENGGGGKYVCSAKLR
MVTGLRNKPSNQSQGLFGAIAGFKEGGWTGMVDGWYGYHHQNEQGSGYAADQKSTQNAINGITNK
VNSVIEKMNTQLTAIGKEVNKSERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI |
| SEQ ID NO: 62: 181H9
MKVKLLVLLCTFTATYADTICIGYHANNSTDTVDTVLEKNVTVTHSVNLLENGGGGKYVCSAKLR
MVTGLRNVPSKQSQGLFGAIAGFIEGGWTGMVDGWYGYHHQNEQGSGYAADQKSTQNAINGITNK
VNSVIEKMNTQFTAVGKEFNKNERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI |
| SEQ ID NO: 63: 220C9
MKVKLLVLLCTFTATYADTICIGYHANNSTDTVDTVLEKNVTVTHSVNLLENGGGGKYVCSAKLR
MVTGLRNKPSTQSQGLFGAIAGFTEGGWTGMVDGWYGYHHQNEQGSGYAADQKSTQNAINGITNK
VNSVIEKMNTQFTATGKEYNKLERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI |
| SEQ ID NO: 64: 113E7
MKVKLLVLLCTFTATYADTICIGYHANNSTDTVDTVLEKNVTVTHSVNLLENGGGGKYVCSAKLR
MVTGLRNKPSKQSQGLFGAIAGFTEGGWTGMVDGWYGYHHQNEQGSGYAADQKSTQNAINGITNK
VNSVIEKMNTQYTATGKEINKHERMKQIEDKIEEIESKQIWCYNAELLVLLENERTLDFHDSNVK
NLYEKVKSQLKNNAKEIGNGCFEFYHKCNDECMESVKNGTYDYPKYSEESKLNREKIDGVKLESM
GVYQILAIYSTVASSLVLLVSLGAISFWMCSNGSLQCRICI |
| SEQ ID NO: 65: s74H9
DTICIGYHANNSTDTVDTVLEKNVTVTHSVNLLENGGGGKYVCSAKLRMVTGLRNKPSNQSQGLF
GAIAGFKEGGWTGMVDGWYGYHHQNEQGSGYAADQKSTQNAINGITNKVNSVIEKMNTQYTAFGK
EMNKSERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH |
| SEQ ID NO: 66: s127H1
DTICIGYHANNSTDTVDTVLEKNVTVTHSVNLLENGGGGKYVCSAKLRMVTGLRNKPSKQSQGLF
GAIAGFTEGGWTGMVDGWYGYHHQNEQGSGYAADQKSTQNAINGITNKVNSVIEKMNTQYTAIGK
EYNKSERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH |
| SEQ ID NO: 67: s86B4
DTICIGYHANNSTDTVDTVLEKNVTVTHSVNLLENGGGGKYVCSAKLRMVTGLRNKPSNQSQGLF
GAIAGYKEGGWTGMVDGWYGYHHQNEQGSGYAADQKSTQNAINGITNKVNSVIEKMNTQFTAIGK
EMNKIERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH |

| SEQUENCES |
| --- |

SEQ ID NO: 68: s55G7
DTICIGYHANNSTDTVDTVLEKNVTVTHSVNLLENGGGGKYVCSAKLRMVTGLRNKPSNQSQGLF
GAIAGYVEGGWTGMVDGWYGYHHQNEQGSGYAADQKSTQNAINGITNKVNSVIEKMNTQYTAIGK
EMNKLERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH

SEQ ID NO: 69: s6E12
DTICIGYHANNSTDTVDTVLEKNVTVTHSVNLLENGGGGKYVCSAKLRMVTGLRNEPSNQSQGLF
GAIAGFIEGGWTGMVDGWYGYHHQNEQGSGYAADQKSTQNAINGITNKVNSVIEKMNTQLTAFGK
EVNKLERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH

SEQ ID NO: 70: s115A1
DTICIGYHANNSTDTVDTVLEKNVTVTHSVNLLENGGGGKYVCSAKLRMVTGLRNKPSKQSQGLF
GAIAGYTEGGWTGMVDGWYGYHHQNEQGSGYAADQKSTQNAINGITNKVNSVIEKMNTQITAVGK
EYNKIERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH

SEQ ID NO: 71: s71H2
DTICIGYHANNSTDTVDTVLEKNVTVTHSVNLLENGGGGKYVCSAKLRMVTGLRNKPSNQSQGLF
GAIAGFKEGGWTGMVDGWYGYHHQNEQGSGYAADQKSTQNAINGITNKVNSVIEKMNTQLTAIGK
EVNKSERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH

SEQ ID NO: 76: s181H9
DTICIGYHANNSTDTVDTVLEKNVTVTHSVNLLENGGGGKYVCSAKLRMVTGLRNVPSKQSQGLF
GAIAGFIEGGWTGMVDGWYGYHHQNEQGSGYAADQKSTQNAINGITNKVNSVIEKMNTQFTAVGK
EFNKNERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH

SEQ ID NO: 77: s220C9
DTICIGYHANNSTDTVDTVLEKNVTVTHSVNLLENGGGGKYVCSAKLRMVTGLRNKPSTQSQGLF
GAIAGFTEGGWTGMVDGWYGYHHQNEQGSGYAADQKSTQNAINGITNKVNSVIEKMNTQFTATGK
EYNKLERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH

SEQ ID NO: 78: s113E7
DTICIGYHANNSTDTVDTVLEKNVTVTHSVNLLENGGGGKYVCSAKLRMVTGLRNKPSKQSQGLF
GAIAGFTEGGWTGMVDGWYGYHHQNEQGSGYAADQKSTQNAINGITNKVNSVIEKMNTQYTATGK
EINKHERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGRSLVPRGSPGHHHHHH

SEQ ID NO: 72: s74H9-long
DTICIGYHANNSTDTVDTVLEKNVTVTHSVNLLENGGGGKYVCSAKLRMVTGLRNKPSNQSQGLF
GAIAGFKEGGWTGMVDGWYGYHHQNEQGSGYAADQKSTQNAINGITNKVNSVIEKMNTQYTAFGK
EMNKSERMKQIEDKIEEIESKQIWCYNAELLVLLENERTLDFHDSNVKNLYEKVKSQLKNNAKEI
GNGCFEFYHKCNDECMESVKNGTYDYPKYSEESKLNREKIDGVKLESMGVYQIEG SEQ ID NO: 73: s127H1-long
DTICIGYHANNSTDTVDTVLEKNVTVTHSVNLLENGGGGKYVCSAKLRMVTGLRNKPSKQSQGLF
GAIAGFTEGGWTGMVDGWYGYHHQNEQGSGYAADQKSTQNAINGITNKVNSVIEKMNTQYTAIGK

| SEQUENCES |
|---|
| EYNKSERMKQIEDKIEEIESKQIWCYNAELLVLLENERTLDFHDSNVKNLYEKVKSQLKNNAKEI |
| GNGCFEFYHKCNDECMESVKNGTYDYPKYSEESKLNREKIDGVKLESMGVYQIEG |
| |
| SEQ ID NO: 74: s86B4-long |
| DTICIGYHANNSTDTVDTVLEKNVTVTHSVNLLENGGGGKYVCSAKLRMVTGLRNKPSNQSQGLF |
| GAIAGYKEGGWTGMVDGWYGYHHQNEQGSGYAADQKSTQNAINGITNKVNSVIEKMNTQFTAIGK |
| EMNKIERMKQIEDKIEEIESKQIWCYNAELLVLLENERTLDFHDSNVKNLYEKVKSQLKNNAKEI |
| GNGCFEFYHKCNDECMESVKNGTYDYPKYSEESKLNREKIDGVKLESMGVYQIEG |
| |
| SEQ ID NO: 75: s55G7-long |
| DTICIGYHANNSTDTVDTVLEKNVTVTHSVNLLENGGGGKYVCSAKLRMVTGLRNKPSNQSQGLF |
| GAIAGYVEGGWTGMVDGWYGYHHQNEQGSGYAADQKSTQNAINGITNKVNSVIEKMNTQYTAIGK |
| EMNKLERMKQIEDKIEEIESKQIWCYNAELLVLLENERTLDFHDSNVKNLYEKVKSQLKNNAKEI |
| GNGCFEFYHKCNDECMESVKNGTYDYPKYSEESKLNREKIDGVKLESMGVYQIEG |
| |
| SEQ ID NO: 144: s6E12-long |
| DTICIGYHANNSTDTVDTVLEKNVTVTHSVNLLENGGGGKYVCSAKLRMVTGLRNEPSNQSQGLF |
| GAIAGFIEGGWTGMVDGWYGYHHQNEQGSGYAADQKSTQNAINGITNKVNSVIEKMNTQLTAFGK |
| EVNKLERMKQIEDKIEEIESKQIWCYNAELLVLLENERTLDFHDSNVKNLYEKVKSQLKNNAKEI |
| GNGCFEFYHKCNDECMESVKNGTYDYPKYSEESKLNREKIDGVKLESMGVYQIEG |
| |
| SEQ ID NO: 79: s115Along |
| DTICIGYHANNSTDTVDTVLEKNVTVTHSVNLLENGGGGKYVCSAKLRMVTGLRNKPSKQSQGLF |
| GAIAGYTEGGWTGMVDGWYGYHHQNEQGSGYAADQKSTQNAINGITNKVNSVIEKMNTQITAVGK |
| EYNKIERMKQIEDKIEEIESKQIWCYNAELLVLLENERTLDFHDSNVKNLYEKVKSQLKNNAKEI |
| GNGCFEFYHKCNDECMESVKNGTYDYPKYSEESKLNREKIDGVKLESMGVYQIEG |
| |
| SEQ ID NO: 80: s71H2long |
| DTICIGYHANNSTDTVDTVLEKNVTVTHSVNLLENGGGGKYVCSAKLRMVTGLRNKPSNQSQGLF |
| GAIAGFKEGGWTGMVDGWYGYHHQNEQGSGYAADQKSTQNAINGITNKVNSVIEKMNTQLTAIGK |
| EVNKSERMKQIEDKIEEIESKQIWCYNAELLVLLENERTLDFHDSNVKNLYEKVKSQLKNNAKEI |
| GNGCFEFYHKCNDECMESVKNGTYDYPKYSEESKLNREKIDGVKLESMGVYQIEG |
| |
| SEQ ID NO: 81: 127H1-t2 |
| MKVKLLVLLCTFTATYADTICIGYHANNSTDTVDTVLEKNVTVTHSVNLLENGGGGKYVCSAKLR |
| MVTGLRNKPSKQSQGLFGAIAGFTEGGWTGMVDGWYGYHHQNEQGSGYAADQKSTQNAINGITNK |
| VNSVIEKMNTQYTAIGKEYNKSERRMKQIEDKIEEIESKIWCYNAELLVLLEMERTLDFHDSNVK |
| NLYEKVKSQLKNNAKEIGNGCFEFYHKCNDECMESVKNGTYDYPKYSEESKLNREKIDGVKLESM |
| GVYQILAIYSTVASSLVLLVSLGAISFWMCSNGSLQCRICI |
| |
| SEQ ID NO: 82: 86B4-t2 |
| MKVKLLVLLCTFTATYADTICIGYHANNSTDTVDTVLEKNVTVTHSVNLLENGGGGKYVCSAKLR |
| MVTGLRNKPSNQSQGLFGAIAGYKEGGWTGMVDGWYGYHHQNEQGSGYAADQKSTQNAINGITNK |
| VNSVIEKMNTQFTAIGKEMNKIERRMKQIEDKIEEIESKIWCYNAELLVLLENERTLDFHDSNVK |
| NLYEKVKSQLKNNAKEIGNGCFEFYHKCNDECMESVKNGTYDYPKYSEESKLNREKIDGVKLESM |
| GVYQILAIYSTVASSLVLLVSLGAISFWMCSNGSLQCRICI |
| |
| SEQ ID NO: 83: 74H9-t2 |
| MKVKLLVLLCTFTATYADTICIGYHANNSTDTVDTVLEKNVTVTHSVNLLENGGGGKYVCSAKLR |
| MVTGLRNKPSNQSQGLFGAIAGFKEGGWTGMVDGWYGYHHQNEQGSGYAADQKSTQNAINGITNK |
| VNSVIEKMNTQYTAFGKEMNKSERRMKQIEDKIEEIESKIWCYNAELLVLLENERTLDFHDSNVK |

SEQUENCES

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 84: 6E12-t2
MKVKLLVLLCTFTATYADTICIGYHANNSTDTVDTVLEKNVTVTHSVNLLENGGGGKYVCSAKLR

MVTGLRNEPSNQSQGLFGAIAGFIEGGWTGMVDGWYGYHHQNEQGSGYAADQKSTQNAINGITNK

VNSVIEKMNTQLTAFGKEVNKLERRMKQIEDKIEEIESKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 85: 55G7-t2
MKVKLLVLLCTFTATYADTICIGYHANNSTDTVDTVLEKNVTVTHSVNLLENGGGGKYVCSAKLR

MVTGLRNKPSNQSQGLFGAIAGYVEGGWTGMVDGWYGYHHQNEQGSGYAADQKSTQNAINGITNK

VNSVIEKMNTQYTAIGKEMNKLERRMKQIEDKIEEIESKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 86: 115A1-t2
MKVKLLVLLCTFTATYADTICIGYHANNSTDTVDTVLEKNVTVTHSVNLLENGGGGKYVCSAKLR

MVTGLRNKPSKQSQGLFGAIAGYTEGGWTGMVDGWYGYHHQNEQGSGYAADQKSTQNAINGITNK

VNSVIEKMNTQITAVGKEYNKIERRMKQIEDKIEEIESKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 87: 71H2-t2
MKVKLLVLLCTFTATYADTICIGYHANNSTDTVDTVLEKNVTVTHSVNLLENGGGGKYVCSAKLR

MVTGLRNKPSNQSQGLFGAIAGFKEGGWTGMVDGWYGYHHQNEQGSGYAADQKSTQNAINGITNK

VNSVIEKMNTQLTAIGKEVNKSERRMKQIEDKIEEIESKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 88: 181H9-t2
MKVKLLVLLCTFTATYADTICIGYHANNSTDTVDTVLEKNVTVTHSVNLLENGGGGKYVCSAKLR

MVTGLRNVPSKQSQGLFGAIAGFIEGGWTGMVDGWYGYHHQNEQGSGYAADQKSTQNAINGITNK

VNSVIEKMNTQFTAVGKEFNKNERRMKQIEDKIEEIESKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 89: 220C9-t2
MKVKLLVLLCTFTATYADTICIGYHANNSTDTVDTVLEKNVTVTHSVNLLENGGGGKYVCSAKLR

MVTGLRNKPSTQSQGLFGAIAGFTEGGWTGMVDGWYGYHHQNEQGSGYAADQKSTQNAINGITNK

VNSVIEKMNTQFTATGKEYNKLERRMKQIEDKIEEIESKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 90: 113E7-t2
MKVKLLVLLCTFTATYADTICIGYHANNSTDTVDTVLEKNVTVTHSVNLLENGGGGKYVCSAKLR

MVTGLRNKPSKQSQGLFGAIAGFTEGGWTGMVDGWYGYHHQNEQGSGYAADQKSTQNAINGITNK

VNSVIEKMNTQYTATGKEINKHERRMKQIEDKIEEIESKIWCYNAELLVLLEMERTLDFHDSNVK

| SEQUENCES |
| --- |
| NLYEKVKSQLKNNAKEIGNGCFEFYHKCNDECMESVKNGTYDYPKYSEESKLNREKIDGVKLESM |
| GVYQILAIYSTVASSLVLLVSLGAISFWMCSNGSLQCRICI |
| SEQ ID NO: 91: s127H1-t2<br>DTICIGYHANNSTDTVDTVLEKNVTVTHSVNLLENGGGGKYVCSAKLRMVTGLRNKPSKQSQGLF |
| GAIAGFTEGGWTGMVDGWYGYHHQNEQGSGYAADQKSTQNAINGITNKVNSVIEKMNTQYTAIGK |
| EYNKSERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |
| SEQ ID NO: 92: s86B4-t2<br>DTICIGYHANNSTDTVDTVLEKNVTVTHSVNLLENGGGGKYVCSAKLRMVTGLRNKPSNQSQGLF |
| GAIAGYKEGGWTGMVDGWYGYHHQNEQGSGYAADQKSTQNAINGITNKVNSVIEKMNTQFTAIGK |
| EMNKIERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |
| SEQ ID NO: 93: s74H9-t2<br>DTICIGYHANNSTDTVDTVLEKNVTVTHSVNLLENGGGGKYVCSAKLRMVTGLRNKPSNQSQGLF |
| GAIAGFKEGGWTGMVDGWYGYHHQNEQGSGYAADQKSTQNAINGITNKVNSVIEKMNTQYTAFGK |
| EMNKSERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |
| SEQ ID NO: 94: s6E12-t2<br>DTICIGYHANNSTDTVDTVLEKNVTVTHSVNLLENGGGGKYVCSAKLRMVTGLRNEPSNQSQGLF |
| GAIAGFIEGGWTGMVDGWYGYHHQNEQGSGYAADQKSTQNAINGITNKVNSVIEKMNTQLTAFGK |
| EVNKLERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |
| SEQ ID NO: 95: s55G7-t2<br>DTICIGYHANNSTDTVDTVLEKNVTVTHSVNLLENGGGGKYVCSAKLRMVTGLRNKPSNQSQGLF |
| GAIAGYVEGGWTGMVDGWYGYHHQNEQGSGYAADQKSTQNAINGITNKVNSVIEKMNTQYTAIGK |
| EMNKLERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |
| SEQ ID NO: 96: s115A1-t2<br>DTICIGYHANNSTDTVDTVLEKNVTVTHSVNLLENGGGGKYVCSAKLRMVTGLRNKPSKQSQGLF |
| GAIAGYTEGGWTGMVDGWYGYHHQNEQGSGYAADQKSTQNAINGITNKVNSVIEKMNTQITAVGK |
| EYNKIERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |
| SEQ ID NO: 97: s71H2-t2<br>DTICIGYHANNSTDTVDTVLEKNVTVTHSVNLLENGGGGKYVCSAKLRMVTGLRNKPSNQSQGLF |
| GAIAGFKEGGWTGMVDGWYGYHHQNEQGSGYAADQKSTQNAINGITNKVNSVIEKMNTQLTAIGK |
| EVNKSERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |
| SEQ ID NO: 98: s181H9-t2<br>DTICIGYHANNSTDTVDTVLEKNVTVTHSVNLLENGGGGKYVCSAKLRMVTGLRNVPSKQSQGLF |
| GAIAGFIEGGWTGMVDGWYGYHHQNEQGSGYAADQKSTQNAINGITNKVNSVIEKMNTQFTAVGK |
| EFNKNERRMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGRSLVPRGSPGHHHHHH |

| SEQUENCES |
| --- |
| SEQ ID NO: 99: s220C9-t2<br>DTICIGYHANNSTDTVDTVLEKNVTVTHSVNLLENGGGGKYVCSAKLRMVTGLRNKPSTQSQGLF<br>GAIAGFTEGGWTGMVDGWYGYHHQNEQGSGYAADQKSTQNAINGITNKVNSVIEKMNTQFTATGK<br>EYNKLERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGRSLVPRGSPGHHHHHH |
| SEQ ID NO: 100: s113E7-t2<br>DTICIGYHANNSTDTVDTVLEKNVTVTHSVNLLENGGGGKYVCSAKLRMVTGLRNKPSKQSQGLF<br>GAIAGFTEGGWTGMVDGWYGYHHQNEQGSGYAADQKSTQNAINGITNKVNSVIEKMNTQYTATGK<br>EINKHERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGRSLVPRGSPGHHHHHH |
| SEQ ID NO: 101: s127H1-t2long<br>DTICIGYHANNSTDTVDTVLEKNVTVTHSVNLLENGGGGKYVCSAKLRMVTGLRNKPSKQSQGLF<br>GAIAGFTEGGWTGMVDGWYGYHHQNEQGSGYAADQKSTQNAINGITNKVNSVIEKMNTQYTAIGK<br>EYNKSERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 102: s86B4-t2long<br>DTICIGYHANNSTDTVDTVLEKNVTVTHSVNLLENGGGGKYVCSAKLRMVTGLRNKPSNQSQGLF<br>GAIAGYKEGGWTGMVDGWYGYHHQNEQGSGYAADQKSTQNAINGITNKVNSVIEKMNTQFTAIGK<br>EMNKIERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 103: s74H9-t2long<br>DTICIGYHANNSTDTVDTVLEKNVTVTHSVNLLENGGGGKYVCSAKLRMVTGLRNKPSNQSQGLF<br>GAIAGFKEGGWTGMVDGWYGYHHQNEQGSGYAADQKSTQNAINGITNKVNSVIEKMNTQYTAFGK<br>EMNKSERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 104: s6E12-t2long<br>DTICIGYHANNSTDTVDTVLEKNVTVTHSVNLLENGGGGKYVCSAKLRMVTGLRNEPSNQSQGLF<br>GAIAGFIEGGWTGMVDGWYGYHHQNEQGSGYAADQKSTQNAINGITNKVNSVIEKMNTQLTAFGK<br>EVNKLERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 105: s55G7-t2long<br>DTICIGYHANNSTDTVDTVLEKNVTVTHSVNLLENGGGGKYVCSAKLRMVTGLRNKPSNQSQGLF<br>GAIAGYVEGGWTGMVDGWYGYHHQNEQGSGYAADQKSTQNAINGITNKVNSVIEKMNTQYTAIGK<br>EMNKLERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 106: s115A1-t2long<br>DTICIGYHANNSTDTVDTVLEKNVTVTHSVNLLENGGGGKYVCSAKLRMVTGLRNKPSKQSQGLF<br>GAIAGYTEGGWTGMVDGWYGYHHQNEQGSGYAADQKSTQNAINGITNKVNSVIEKMNTQITAVGK<br>EYNKIERRMKQIEDKIEEIESKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 107: s71H2-t2long<br>DTICIGYHANNSTDTVDTVLEKNVTVTHSVNLLENGGGGKYVCSAKLRMVTGLRNKPSNQSQGLF<br>GAIAGFKEGGWTGMVDGWYGYHHQNEQGSGYAADQKSTQNAINGITNKVNSVIEKMNTQLTAIGK |

EVNKSERRMKQIEDKIEEIESKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 108: s181H9-t2long
DTICIGYHANNSTDTVDTVLEKNVTVTHSVNLLENGGGGKYVCSAKLRMVTGLRNVPSKQSQGLF

GAIAGFIEGGWTGMVDGWYGYHHQNEQGSYAADQKSTQNAINGITNKVNSVIEKMNTQFTAVGK

EFNKNERRMKQIEDKIEEIESKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 109: s220C9-t2long
DTICIGYHANNSTDTVDTVLEKNVTVTHSVNLLENGGGGKYVCSAKLRMVTGLRNKPSTQSQGLF

GAIAGFTEGGWTGMVDGWYGYHHQNEQGSYAADQKSTQNAINGITNKVNSVIEKMNTQFTATGK

EYNKLERRMKQIEDKIEEIESKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 110: s113E7-t2long
DTICIGYHANNSTDTVDTVLEKNVTVTHSVNLLENGGGGKYVCSAKLRMVTGLRNKPSKQSQGLF

GAIAGFTEGGWTGMVDGWYGYHHQNEQGSYAADQKSTQNAINGITNKVNSVIEKMNTQYTATGK

EINKHERRMKQIEDKIEEIESKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 111: 127H1-t3
MKVKLLVLLCTFTATYADTICIGYHANNSTDTVDTVLEKNVTVTHSVNLLENGGGGKYVCSAKLR

MVTGLRNKPSKQSQGLFGAIAGFTEGGWTGMVDGWYGYHHQNEQGSYAADQKSTQNAINGITNK

VNSVIEKMNTQYTAIGKEYNKSRMKQIEDKIEEIESKQKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 112: 86B4-t3
MKVKLLVLLCTFTATYADTICIGYHANNSTDTVDTVLEKNVTVTHSVNLLENGGGGKYVCSAKLR

MVTGLRNKPSNQSQGLFGAIAGYKEGGWTGMVDGWYGYHHQNEQGSYAADQKSTQNAINGITNK

VNSVIEKMNTQFTAIGKEMNKIRMKQIEDKIEEIESKQKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 113: 74H9-t3
MKVKLLVLLCTFTATYADTICIGYHANNSTDTVDTVLEKNVTVTHSVNLLENGGGGKYVCSAKLR

MVTGLRNKPSNQSQGLFGAIAGFKEGGWTGMVDGWYGYHHQNEQGSYAADQKSTQNAINGITNK

VNSVIEKMNTQYTAFGKEMNKSRMKQIEDKIEEIESKQKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

SEQ ID NO: 114: 6E12-t3
MKVKLLVLLCTFTATYADTICIGYHANNSTDTVDTVLEKNVTVTHSVNLLENGGGGKYVCSAKLR

MVTGLRNEPSNQSQGLFGAIAGFIEGGWTGMVDGWYGYHHQNEQGSYAADQKSTQNAINGITNK

VNSVIEKMNTQLTAFGKEVNKLRMKQIEDKIEEIESKQKIWCYNAELLVLLENERTLDFHDSNVK

NLYEKVKSQLKNNAKEIGNGCFEFYHKCNDECMESVKNGTYDYPKYSEESKLNREKIDGVKLESM

GVYQILAIYSTVASSLVLLVSLGAISFWMCSNGSLQCRICI

| SEQUENCES |
| --- |
| SEQ ID NO: 115: 55G7-t3<br>MKVKLLVLLCTFTATYADTICIGYHANNSTDTVDTVLEKNVTVTHSVNLLENGGGGKYVCSAKLR<br>MVTGLRNKPSNQSQGLFGAIAGYVEGGWTGMVDGWYGYHHQNEQGSGYAADQKSTQNAINGITNK<br>VNSVIEKMNTQYTAIGKEMNKLRMKQIEDKIEEIESKQKIWCYNAELLVLLENERTLDFHDSNVK<br>NLYEKVKSQLKNNAKEIGNGCFEFYHKCNDECMESVKNGTYDYPKYSEESKLNREKIDGVKLESM<br>GVYQILAIYSTVASSLVLLVSLGAISFWMCSNGSLQCRICI |
| SEQ ID NO: 116: 115A1-t3<br>MKVKLLVLLCTFTATYADTICIGYHANNSTDTVDTVLEKNVTVTHSVNLLENGGGGKYVCSAKLR<br>MVTGLRNKPSKQSQGLFGAIAGYTEGGWTGMVDGWYGYHHQNEQGSGYAADQKSTQNAINGITNK<br>VNSVIEKMNTQITAVGKEYNKIRMKQIEDKIEEIESKQKIWCYNAELLVLLENERTLDFHDSNVK<br>NLYEKVKSQLKNNAKEIGNGCFEFYHKCNDECMESVKNGTYDYPKYSEESKLNREKIDGVKLESM<br>GVYQILAIYSTVASSLVLLVSLGAISFWMCSNGSLQCRICI |
| SEQ ID NO: 117: 71H2-t3<br>MKVKLLVLLCTFTATYADTICIGYHANNSTDTVDTVLEKNVTVTHSVNLLENGGGGKYVCSAKLR<br>MVTGLRNKPSNQSQGLFGAIAGFKEGGWTGMVDGWYGYHHQNEQGSGYAADQKSTQNAINGITNK<br>VNSVIEKMNTQLTAIGKEVNKSRMKQIEDKIEEIESKQKIWCYNAELLVLLENERTLDFHDSNVK<br>NLYEKVKSQLKNNAKEIGNGCFEFYHKCNDECMESVKNGTYDYPKYSEESKLNREKIDGVKLESM<br>GVYQILAIYSTVASSLVLLVSLGAISFWMCSNGSLQCRICI |
| SEQ ID NO: 118: 181H9-t3<br>MKVKLLVLLCTFTATYADTICIGYHANNSTDTVDTVLEKNVTVTHSVNLLENGGGGKYVCSAKLR<br>MVTGLRNVPSKQSQGLFGAIAGFIEGGWTGMVDGWYGYHHQNEQGSGYAADQKSTQNAINGITNK<br>VNSVIEKMNTQFTAVGKEFNKNRMKQIEDKIEEIESKQKIWCYNAELLVLLENERTLDFHDSNVK<br>NLYEKVKSQLKNNAKEIGNGCFEFYHKCNDECMESVKNGTYDYPKYSEESKLNREKIDGVKLESM<br>GVYQILAIYSTVASSLVLLVSLGAISFWMCSNGSLQCRICI |
| SEQ ID NO: 119: 220C9-t3<br>MKVKLLVLLCTFTATYADTICIGYHANNSTDTVDTVLEKNVTVTHSVNLLENGGGGKYVCSAKLR<br>MVTGLRNKPSTQSQGLFGAIAGFTEGGWTGMVDGWYGYHHQNEQGSGYAADQKSTQNAINGITNK<br>VNSVIEKMNTQFTATGKEYNKLRMKQIEDKIEEIESKQKIWCYNAELLVLLENERTLDFHDSNVK<br>NLYEKVKSQLKNNAKEIGNGCFEFYHKCNDECMESVKNGTYDYPKYSEESKLNREKIDGVKLESM<br>GVYQILAIYSTVASSLVLLVSLGAISFWMCSNGSLQCRICI |
| SEQ ID NO: 120: 113E7-t3<br>MKVKLLVLLCTFTATYADTICIGYHANNSTDTVDTVLEKNVTVTHSVNLLENGGGGKYVCSAKLR<br>MVTGLRNKPSKQSQGLFGAIAGFTEGGWTGMVDGWYGYHHQNEQGSGYAADQKSTQNAINGITNK<br>VNSVIEKMNTQYTATGKEINKHRMKQIEDKIEEIESKQKIWCYNAELLVLLENERTLDFHDSNVK<br>NLYEKVKSQLKNNAKEIGNGCFEFYHKCNDECMESVKNGTYDYPKYSEESKLNREKIDGVKLESM<br>GVYQILAIYSTVASSLVLLVSLGAISFWMCSNGSLQCRICI |
| SEQ ID NO: 121: s127H1-t3<br>DTICIGYHANNSTDTVDTVLEKNVTVTHSVNLLENGGGGKYVCSAKLRMVTGLRNKPSKQSQGLF<br>GAIAGFTEGGWTGMVDGWYGYHHQNEQGSGYAADQKSTQNAINGITNKVNSVIEKMNTQYTAIGK<br>EYNKSRMKQIEDKIEEIESKQKIWCYNAELLVLLENERTLDFHDSNVKNLYEKVKSQLKNNAKEI<br>GNGCFEFYHKCNDECMESVKNGTYDYPKYSEESKLNREKIDGRSLVPRGSPGHHHHHH |

| SEQUENCES |
| --- |

SEQ ID NO: 122: s86B4-t3
DTICIGYHANNSTDTVDTVLEKNVTVTHSVNLLENGGGGKYVCSAKLRMVTGLRNKPSNQSQGLF

GAIAGYKEGGWTGMVDGWYGYHHQNEQGSGYAADQKSTQNAINGITNKVNSVIEKMNTQFTAIGK

EMNKIRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 123: s74H9-t3
DTICIGYHANNSTDTVDTVLEKNVTVTHSVNLLENGGGGKYVCSAKLRMVTGLRNKPSNQSQGLF

GAIAGFKEGGWTGMVDGWYGYHHQNEQGSGYAADQKSTQNAINGITNKVNSVIEKMNTQYTAFGK

EMNKSRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 124: s6E12-t3
DTICIGYHANNSTDTVDTVLEKNVTVTHSVNLLENGGGGKYVCSAKLRMVTGLRNEPSNQSQGLF

GAIAGFIEGGWTGMVDGWYGYHHQNEQGSGYAADQKSTQNAINGITNKVNSVIEKMNTQLTAFGK

EVNKLRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 125: s55G7-t3
DTICIGYHANNSTDTVDTVLEKNVTVTHSVNLLENGGGGKYVCSAKLRMVTGLRNKPSNQSQGLF

GAIAGYVEGGWTGMVDGWYGYHHQNEQGSGYAADQKSTQNAINGITNKVNSVIEKMNTQYTAIGK

EMNKLRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 126: s115A1-t3
DTICIGYHANNSTDTVDTVLEKNVTVTHSVNLLENGGGGKYVCSAKLRMVTGLRNKPSKQSQGLF

GAIAGYTEGGWTGMVDGWYGYHHQNEQGSGYAADQKSTQNAINGITNKVNSVIEKMNTQITAVGK

EYNKIRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 127: s71H2-t3
DTICIGYHANNSTDTVDTVLEKNVTVTHSVNLLENGGGGKYVCSAKLRMVTGLRNKPSNQSQGLF

GAIAGFKEGGWTGMVDGWYGYHHQNEQGSGYAADQKSTQNAINGITNKVNSVIEKMNTQLTAIGK

EVNKSRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 128: s181H9-t3
DTICIGYHANNSTDTVDTVLEKNVTVTHSVNLLENGGGGKYVCSAKLRMVTGLRNVPSKQSQGLF

GAIAGFIEGGWTGMVDGWYGYHHQNEQGSGYAADQKSTQNAINGITNKVNSVIEKMNTQFTAVGK

EFNKNRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 129: s220C9-t3
DTICIGYHANNSTDTVDTVLEKNVTVTHSVNLLENGGGGKYVCSAKLRMVTGLRNKPSTQSQGLF

GAIAGFTEGGWTGMVDGWYGYHHQNEQGSGYAADQKSTQNAINGITNKVNSVIEKMNTQFTATGK

EYNKLRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 130: s113E7-t3
DTICIGYHANNSTDTVDTVLEKNVTVTHSVNLLENGGGGKYVCSAKLRMVTGLRNKPSKQSQGLF

GAIAGFTEGGWTGMVDGWYGYHHQNEQGSGYAADQKSTQNAINGITNKVNSVIEKMNTQYTATGK

| SEQUENCES |
| --- |
| EINKHRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGRSLVPRGSPGHHHHHH

SEQ ID NO: 131: s127H1-t3long
GAIAGFTEGGWTGMVDGWYGYHHQNEQGSYAADQKSTQNAINGITNKVNSVIEKMNTQYTAIGK

EYNKSRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 132: s86B4-t3long
DTICIGYHANNSTDTVDTVLEKNVTVTHSVNLLENGGGGKYVCSAKLRMVTGLRNKPSNQSQGLF

GAIAGYKEGGWTGMVDGWYGYHHQNEQGSYAADQKSTQNAINGITNKVNSVIEKMNTQFTAIGK

EMNKIRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 133: s74H9-t3long
DTICIGYHANNSTDTVDTVLEKNVTVTHSVNLLENGGGGKYVCSAKLRMVTGLRNKPSNQSQGLF

GAIAGFKEGGWTGMVDGWYGYHHQNEQGSYAADQKSTQNAINGITNKVNSVIEKMNTQYTAFGK

EMNKSRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 134: s6E12-t3long
DTICIGYHANNSTDTVDTVLEKNVTVTHSVNLLENGGGGKYVCSAKLRMVTGLRNEPSNQSQGLF

GAIAGFIEGGWTGMVDGWYGYHHQNEQGSYAADQKSTQNAINGITNKVNSVIEKMNTQLTAFGK

EVNKLRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 135: s55G7-t3long
DTICIGYHANNSTDTVDTVLEKNVTVTHSVNLLENGGGGKYVCSAKLRMVTGLRNKPSNQSQGLF

GAIAGYVEGGWTGMVDGWYGYHHQNEQGSYAADQKSTQNAINGITNKVNSVIEKMNTQYTAIGK

EMNKLRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 136: s115A1-t3long
DTICIGYHANNSTDTVDTVLEKNVTVTHSVNLLENGGGGKYVCSAKLRMVTGLRNKPSKQSQGLF

GAIAGYTEGGWTGMVDGWYGYHHQNEQGSYAADQKSTQNAINGITNKVNSVIEKMNTQITAVGK

EYNKIRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 137: s71H2-t3long
DTICIGYHANNSTDTVDTVLEKNVTVTHSVNLLENGGGGKYVCSAKLRMVTGLRNKPSNQSQGLF

GAIAGFKEGGWTGMVDGWYGYHHQNEQGSYAADQKSTQNAINGITNKVNSVIEKMNTQLTAIGK

EVNKSRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG

SEQ ID NO: 138: s181H9-t3long
DTICIGYHANNSTDTVDTVLEKNVTVTHSVNLLENGGGGKYVCSAKLRMVTGLRNVPSKQSQGLF

GAIAGFIEGGWTGMVDGWYGYHHQNEQGSYAADQKSTQNAINGITNKVNSVIEKMNTQFTAVGK

EFNKNRMKQIEDKIEEIESKQKIWCYNAELLVLLENERTLDFHDSNVKNLYEKVKSQLKNNAKEI

GNGCFEFYHKCNDECMESVKNGTYDYPKYSEESKLNREKIDGVKLESMGVYQIEG |

| SEQUENCES |
| --- |
| SEQ ID NO: 139: s220C9-t3long<br>DTICIGYHANNSTDTVDTVLEKNVTVTHSVNLLENGGGGKYVCSAKLRMVTGLRNKPSTQSQGLF<br>GAIAGFTEGGWTGMVDGWYGYHHQNEQGSGYAADQKSTQNAINGITNKVNSVIEKMNTQFTATGK<br>EYNKLRMKQIEDKIEEIESKQKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 140: s113E7-t3long<br>DTICIGYHANNSTDTVDTVLEKNVTVTHSVNLLENGGGGKYVCSAKLRMVTGLRNKPSKQSQGLF<br>GAIAGFTEGGWTGMVDGWYGYHHQNEQGSGYAADQKSTQNAINGITNKVNSVIEKMNTQYTATGK<br>EINKHRMKQIEDKIEEIESKQKIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 141: s181H9long<br>DTICIGYHANNSTDTVDTVLEKNVTVTHSVNLLENGGGGKYVCSAKLRMVTGLRNVPSKQSQGLF<br>GAIAGFIEGGWTGMVDGWYGYHHQNEQGSGYAADQKSTQNAINGITNKVNSVIEKMNTQFTAVGK<br>EFNKNERMKQIEDKIEEIESKQIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 142: s220C9long<br>DTICIGYHANNSTDTVDTVLEKNVTVTHSVNLLENGGGGKYVCSAKLRMVTGLRNKPSTQSQGLF<br>GAIAGFTEGGWTGMVDGWYGYHHQNEQGSGYAADQKSTQNAINGITNKVNSVIEKMNTQFTATGK<br>EYNKLERMKQIEDKIEEIESKQIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 143: s113E7long<br>DTICIGYHANNSTDTVDTVLEKNVTVTHSVNLLENGGGGKYVCSAKLRMVTGLRNKPSKQSQGLF<br>GAIAGFTEGGWTGMVDGWYGYHHQNEQGSGYAADQKSTQNAINGITNKVNSVIEKMNTQYTATGK<br>EINKHERMKQIEDKIEEIESKQIWCYNAELLVLLENERTLDFHDSNVKNLYEKVKSQLKNNAKEI<br>GNGCFEFYHKCNDECMESVKNGTYDYPKYSEESKLNREKIDGVKLESMGVYQIEG |
| SEQ ID NO: 149: 55G7-t2-cl14<br>MKVKLLVLLCTFTATYADTICIGYHANNSTDTVDTVLEKNVTVTHSVNLLENGGGGKYVC<br>SAKLRMVTGLRNKPSNQSQGLFGAIAGYVEGGWTGMVDGWYGYHHQNEQGSGYAADQKST<br>QNAINGITNKVNSVIEKMNTQYTAIGKEMNKLERRMKQCCDKIEEIESKIWCYNAELLVL<br>LENERTLDFHDSNVKNLYEKVKSQLKNNAKEIGNGCFEFYHKCNDECMESVKNGTYDYPK<br>YSEESKLNREKIDGVKLESMGVYQILAIYSTVASSLVLLVSLGAISFWMCSNGSLQCRICI |
| SEQ ID NO: 150: 55G7-t2-cl15<br>MKVKLLVLLCTFTATYADTICIGYHANNSTDTVDTVLEKNVTVTHSVNLLENGGGGKYVC<br>SAKLRMVTGLRNKPSNQSQGLFGAIAGYVEGGWTGMVDGWYGYHHQNEQGSGYAADQKST<br>QNAINGITNKVNSVIEKMNTQYTAIGKEMNKLERRMKQIEDKIEECCSKIWCYNAELLVL<br>LENERTLDFHDSNVKNLYEKVKSQLKNNAKEIGNGCFEFYHKCNDECMESVKNGTYDYPK<br>YSEESKLNREKIDGVKLESMGVYQILAIYSTVASSLVLLVSLGAISFWMCSNGSLQCRICI |
| SEQ ID NO: 151: 55G7-t2-cl16<br>MKVKLLVLLCTFTATYADTICIGYHANNSTDTVDTVLEKNVTVTHSVNLLENGGGGKYVC<br>SAKLRMVTGLRNKPSNQSQGLFGAIAGYVEGGWTGMVDGWYGYHHQNEQGSGYAADQKST<br>QNAINGITNKVNSVIEKMNCQYTAIGKEMNKLERRMKQIEDKIEEIESCIWCYNAELLVL<br>LENERTLDFHDSNVKNLYEKVKSQLKNNAKEIGNGCFEFYHKCNDECMESVKNGTYDYPK<br>YSEESKLNREKIDGVKLESMGVYQILAIYSTVASSLVLLVSLGAISFWMCSNGSLQCRICI |

SEQUENCES

SEQ ID NO: 152: 55G7-t2-cl17
MKVKLLVLLCTFTATYADTICIGYHANNSTDTVDTVLEKNVTVTHSVNLLENGGGGKYVC
SAKLRMVTGLRNKPSNQSQGLFGAIAGYVEGGWTGMVDGWYGYHHQNEQGSGYAADQKST
QNAINGITNKVNSVIEKMNTCYTAIGKEMNKLERRMKQIEDKIECIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 153: 55G7-t2-Cl18
MKVKLLVLLCTFTATYADTICIGYHANNSTDTVDTVLEKNVTVTHSVNLLENGGGGKYVC
SAKLRMVTGLRNKPSNQSQGLFGAIAGYVEGGWTGMVDGWYGYHHQNEQGSGYAADQKST
QNAINGITNKVNSVIEKMNTQYTAIGCEMNKLERCMKQIEDKIEEIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 154: 55G7-t2-cl19
MKVKLLVLLCTFTATYADTICIGYHANNSTDTVDTVLCKNVTVTHSVNLLENGGGGKYVC
SAKLRMVTGLRNKPSNQSQGLFGAIAGYVEGGWTGMVDGWYGYHHQNEQGSGYAADQKST
QNAINCITNKVNSVIEKMNTQYTAIGKEMNKLERRMKQIEDKIEEIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 155: 55G7-t2-Cl21
MKVKLLVLLCTFTATYADTICIGYHANNSTDTVDTVLECNVTVTHSVNLLENGGGGKYVC
SAKLRMVTGLRNKPSNQSQGLFGAIAGYVEGGWTGMVDGWYGYHHQNEQGSGYAADQKST
QNAINGITCKVNSVIEKMNTQYTAIGKEMNKLERRMKQIEDKIEEIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 156: 55G7-t2-cl22
MKVKLLVLLCTFTATYADTICIGYHANNSTDTVDTCLEKNVTVTHSVNLLENGGGGKYVC
SAKLRMVTGLRNKPSNQSQGLFGAIAGYVEGGWTGMVDGWYGYHHQNEQGSGYAADQKST
QNAINGITNCVNSVIEKMNTQYTAIGKEMNKLERRMKQIEDKIEEIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 157: 55G7-t2-cl23
MKVKLLVLLCTFTATYADTICIGYHANNSTDTVDTVLEKNVTVTHSVNLLENGGGGKYVC
SAKLRMVTGLRNKPSNQCQGLFGAIAGYVEGGWTGIWDGWYGYHHQNEQGSGYAADQKST
QNAINGITNKVNSVIEKMNTQYTAIGKEMNKLERRMKQIEDKIEEIESKIWCYNAELLVL
LENERTLDFHDSNVKCLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 158: 55G7-t2-cl24
MKVKLLVLLCTFTATYADTICIGYHANNSTDTVDTVLEKNVTVTHSVNLLENGGGGKYVC
SAKLRMVTGLRNKPSNQSQCLFGAIAGYVEGGWTGMVDGWYGYHHQNEQGSGYAADQKST
QNAINGITNKVNSVIEKMNTQYTAIGKEMNKLERRMKQIEDKIEEIESKIWCYNAELLVL
LENERTLDFHDSNVKNLYEKVKCQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQUENCES

SEQ ID NO: 159: 55G7-t2-cl25
MKVKLLVLLCTFTATYADTICIGYHANNSTDTVDTVLEKNVTVTHSVNLLENGGGGKYVC
SAKLRMVTGLRNKPSNQSQCLFGAIAGYVEGGWTGMVDGWYGYHHQNEQGSGYAADQKST
QNAINGITNKVNSVIEKMNTQYTAIGKEMNKLERRMKQIEDKIEEIESKIWCYNAELLVL
LENERTLDFHDSNVKNLYECVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 160: 127H1-t2-cl14
MKVKLLVLLCTFTATYADTICIGYHANNSTDTVDTVLEKNVTVTHSVNLLENGGGGKYVC
SAKLRMVTGLRNKPSKQSQGLFGAIAGFTEGGWTGMVDGWYGYHHQNEQGSGYAADQKST
QNAINGITNKVNSVIEKMNTQYTAIGKEYNKSERRMQCCDKIEEIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 161: 127H1-t2-cl15
MKVKLLVLLCTFTATYADTICIGYHANNSTDTVDTVLEKNVTVTHSVNLLENGGGGKYVC
SAKLRMVTGLRNKPSKQSQGLFGAIAGFTEGGWTGMVDGWYGYHHQNEQGSGYAADQKST
QNAINGITNKVNSVIEKMNTQYTAIGKEYNKSERRMKQIEDKIEECCSKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 162: 127H1-t2-cl16
MKVKLLVLLCTFTATYADTICIGYHANNSTDTVDTVLEKNVTVTHSVNLLENGGGGKYVC
SAKLRMVTGLRNKPSKQSQGLFGAIAGFTEGGWTGMVDGWYGYHHQNEQGSGYAADQKST
QNAINGITNKVNSVIEKMNCQYTAIGKEYNKSERRMKQIEDKIEEIESCIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 163: 127H1-t2-cl17
MKVKLLVLLCTFTATYADTICIGYHANNSTDTVDTVLEKNVTVTHSVNLLENGGGGKYVC
SAKLRMVTGLRNKPSKQSQGLFGAIAGFTEGGWTGMVDGWYGYHHQNEQGSGYAADQKST
QNAINGITNKVNSVIEKMNTCYTAIGKEYNKSERRMKQIEDKIECIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 164: 127H1-t2-cl18
MKVKLLVLLCTFTATYADTICIGYHANNSTDTVDTVLEKNVTVTHSVNLLENGGGGKYVC
SAKLRMVTGLRNKPSKQSQGLFGAIAGFTEGGWTGMVDGWYGYHHQNEQGSGYAADQKST
QNAINGITNKVNSVIEKMNTQYTAIGCEYNKSERCMKQIEDKIEEIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

SEQ ID NO: 165: 127H1-t2-cl19
MKVKLLVLLCTFTATYADTICIGYHANNSTDTVDTVLCKNVTVTHSVNLLENGGGGKYVC
SAKLRMVTGLRNKPSKQSQGLFGAIAGFTEGGWTGMVDGWYGYHHQNEQGSGYAADQKST
QNAINCITNKVNSVIEKMNTQYTAIGKEYNKSERRMKQIEDKIEEIESKIWCYNAELLVL
LENERTLDFHDSNVKNLYEKVKSQLKNNAKEIGNGCFEFYHKCNDECMESVKNGTYDYPK
YSEESKLNREKIDGVKLESMGVYQILAIYSTVASSLVLLVSLGAISFWMCSNGSLQCRICI

| SEQUENCES |
| --- |

SEQ ID NO: 166: 127H1-t2-cl21
MKVKLLVLLCTFTATYADTICIGYHANNSTDTVDTVLECNVTVTHSVNLLENGGGGKYVC

SAKLRMVTGLRNKPSKQSQGLFGAIAGFTEGGWTGMVDGWYGYHHQNEQGSGYAADQKST

QNAINGITCKVNSVIEKMNTQYTAIGKEYNKSERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQILAIYSTVASSLVLLVSLGAISFWMCSNGSLQCRICI

SEQ ID NO: 167: 127H1-t2-cl22
MKVKLLVLLCTFTATYADTICIGYHANNSTDTVDTCLEKNVTVTHSVNLLENGGGGKYVC

SAKLRMVTGLRNKPSKQSQGLFGAIAGFTEGGWTGMVDGWYGYHHQNEQGSGYAADQKST

QNAINGITNCVNSVIEKMNTQYTAIGKEYNKSERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQILAIYSTVASSLVLLVSLGAISFWMCSNGSLQCRICI

SEQ ID NO: 168: 127H1-t2-cl23
MKVKLLVLLCTFTATYADTICIGYHANNSTDTVDTVLEKNVTVTHSVNLLENGGGGKYVC

SAKLRMVTGLRNKPSKQCQGLFGAIAGFTEGGWTGMVDGWYGYHHQNEQGSGYAADQKST

QNAINGITNKVNSVIEKMNTQYTAIGKEYNKSERRMKQIEDKIEEIESKIWCYNAELLVL

LENERTLDFHDSNVKCLYEKVKSQLKNNAKEIGNGCFEFYHKCNDECMESVKNGTYDYPK

YSEESKLNREKIDGVKLESMGVYQILAIYSTVASSLVLLVSLGAISFWMCSNGSLQCRICI

SEQ ID NO: 169: 127H1-t2-cl24
MKVKLLVLLCTFTATYADTICIGYHANNSTDTVDTVLEKNVTVTHSVNLLENGGGGKYVC

SAKLRMVTGLRNKPSKQSQCLFGAIAGFTEGGWTGMVDGWYGYHHQNEQGSGYAADQKST

QNAINGITNKVNSVIEKMNTQYTAIGKEYNKSERRMKQIEDKIEEIESKIWCYNAELLVL

LENERTLDFHDSNVKNLYEKVKCQLKNNAKEIGNGCFEFYHKCNDECMESVKNGTYDYPK

YSEESKLNREKIDGVKLESMGVYQILAIYSTVASSLVLLVSLGAISFWMCSNGSLQCRICI

SEQ ID NO: 170: 127H1-t2-cl25
MKVKLLVLLCTFTATYADTICIGYHANNSTDTVDTVLEKNVTVTHSVNLLENGGGGKYVC

SAKLRMVTGLRNKPSKQSQCLFGAIAGFTEGGWTGMVDGWYGYHHQNEQGSGYAADQKST

QNAINGITNKVNSVIEKMNTQYTAIGKEYNKSERRMKQIEDKIEEIESKIWCYNAELLVL

LENERTLDFHDSNVKNLYECVKSQLKNNAKEIGNGCFEFYHKCNDECMESVKNGTYDYPK

YSEESKLNREKIDGVKLESMGVYQILAIYSTVASSLVLLVSLGAISFWMCSNGSLQCRICI

SEQ ID NO: 171: s55G7-t2-cl14long
DTICIGYHANNSTDTVDTVLEKNVTVTHSVNLLENGGGGKYVC

SAKLRMVTGLRNKPSNQSQGLFGAIAGYVEGGWTGMVDGWYGYHHQNEQGSGYAADQKST

QNAINGITNKVNSVIEKMNTQYTAIGKEMNKLERRMKQCCDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 172: s55G7-t2-cl15long
DTICIGYHANNSTDTVDTVLEKNVTVTHSVNLLENGGGGKYVC

SAKLRMVTGLRNKPSNQSQGLFGAIAGYVEGGWTGMVDGWYGYHHQNEQGSGYAADQKST

QNAINGITNKVNSVIEKMNTQYTAIGKEMNKLERRMKQIEDKIEECCSKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

| SEQUENCES |
|---|

SEQ ID NO: 173: s55G7-t2-cl16long
DTICIGYHANNSTDTVDTVLEKNVTVTHSVNLLENGGGGKYVC

SAKLRMVTGLRNKPSNQSQGLFGAIAGYVEGGWTGMVDGWYGYHHQNEQGSGYAADQKST

QNAINGITNKVNSVIEKMNCQYTAIGKEMNKLERRMKQIEDKIEEIESCIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 174: s55G7-t2-cl17long
DTICIGYHANNSTDTVDTVLEKNVTVTHSVNLLENGGGGKYVC

SAKLRMVTGLRNKPSNQSQGLFGAIAGYVEGGWTGMVDGWYGYHHQNEQGSGYAADQKST

QNAINGITNKVNSVIEKMNTCYTAIGKEMNKLERRMKQIEDKIECIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 175: s55G7-t2-cl18long
DTICIGYHANNSTDTVDTVLEKNVTVTHSVNLLENGGGGKYVC

SAKLRMVTGLRNKPSNQSQGLFGAIAGYVEGGWTGMVDGWYGYHHQNEQGSGYAADQKST

QNAINGITNKVNSVIEKMNTQYTAIGCEMNKLERCMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 176: s55G7-t2-cl19long
DTICIGYHANNSTDTVDTVLCKNVTVTHSVNLLENGGGGKYVC

SAKLRMVTGLRNKPSNQSQGLFGAIAGYVEGGWTGMVDGWYGYHHQNEQGSGYAADQKST

QNAINCITNKVNSVIEKMNTQYTAIGKEMNKLERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 177: s55G7-t2-cl21long
DTICIGYHANNSTDTVDTVLECNVTVTHSVNLLENGGGGKYVC

SAKLRMVTGLRNKPSNQSQGLFGAIAGYVEGGWTGMVDGWYGYHHQNEQGSGYAADQKST

QNAINGITCKVNSVIEKMNTQYTAIGKEMNKLERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 178: s55G7-t2-cl22long
DTICIGYHANNSTDTVDTCLEKNVTVTHSVNLLENGGGGKYVC

SAKLRMVTGLRNKPSNQSQGLFGAIAGYVEGGWTGMVDGWYGYHHQNEQGSGYAADQKST

QNAINGITNCVNSVIEKMNTQYTAIGKEMNKLERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 179: s55G7-t2-cl23long
DTICIGYHANNSTDTVDTVLEKNVTVTHSVNLLENGGGGKYVC

SAKLRMVTGLRNKPSNQCQGLFGAIAGYVEGGWTGMVDGWYGYHHQNEQGSGYAADQKST

QNAINGITNKVNSVIEKMNTQYTAIGKEMNKLERRMKQIEDKIEEIESKIWCYNAELLVL

LENERTLDFHDSNVKCLYEKVKSQLKNNAKEIGNGCFEFYHKCNDECMESVKNGTYDYPK

YSEESKLNREKIDGVKLESMGVYQIEG

| SEQUENCES |
| --- |

SEQ ID NO: 180: s55G7-t2-cl24long
DTICIGYHANNSTDTVDTVLEKNVTVTHSVNLLENGGGGKYVC

SAKLRMVTGLRNKPSNQSQCLFGAIAGYVEGGWTGMVDGWYGYHHQNEQGSGYAADQKST

QNAINGITNKVNSVIEKMNTQYTAIGKEMNKLERRMKQIEDKIEEIESKIWCYNAELLVL

LENERTLDFHDSNVKNLYEKVKCQLKNNAKEIGNGCFEFYHKCNDECMESVKNGTYDYPK

YSEESKLNREKIDGVKLESMGVYQIEG

SEQ ID NO: 181: s55G7-t2-cl25long
DTICIGYHANNSTDTVDTVLEKNVTVTHSVNLLENGGGGKYVC

SAKLRMVTGLRNKPSNQSQCLFGAIAGYVEGGWTGMVDGWYGYHHQNEQGSGYAADQKST

QNAINGITNKVNSVIEKMNTQYTAIGKEMNKLERRMKQIEDKIEEIESKIWCYNAELLVL

LENERTLDFHDSNVKNLYECVKSQLKNNAKEIGNGCFEFYHKCNDECMESVKNGTYDYPK

YSEESKLNREKIDGVKLESMGVYQIEG

SEQ ID NO: 182: s127H1-t2-cl14long
DTICIGYHANNSTDTVDTVLEKNVTVTHSVNLLENGGGGKYVC

SAKLRMVTGLRNKPSKQSQGLFGAIAGFTEGGWTGMVDGWYGYHHQNEQGSGYAADQKST

QNAINGITNKVNSVIEKMNTQYTAIGKEYNKSERRMKQCCDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 183: s127H1-t2-cl15long
DTICIGYHANNST DTVDTVLEKNVTVTH SVNLLENGGGGKYVC

SAKLRMVTGLRNKPSKQSQGLFGAIAGFTEGGWTGMVDGWYGYHHQNEQGSGYAADQKST

QNAINGITNKVNSVIEKMNTQYTAIGKEYNKSERRMKQIEDKIEECCSKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 184: s127H1-t2-cl16long
DTICIGYHANNSTDTVDTVLEKNVTVTHSVNLLENGGGGKYVC

SAKLRMVTGLRNKPSKQSQGLFGAIAGFTEGGWTGMVDGWYGYHHQNEQGSGYAADQKST

QNAINGITNKVNSVIEKMNCQYTAIGKEYNKSERRMKQIEDKIEEIESCIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 185: s127H1-t2-cl17long
DTICIGYHANNSTDTVDTVLEKNVTVTHSVNLLENGGGGKYVC

SAKLRMVTGLRNKPSKQSQGLFGAIAGFTEGGWTGMVDGWYGYHHQNEQGSGYAADQKST

QNAINGITNKVNSVIEKMNTCYTAIGKEYNKSERRMKQIEDKIECIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 186: s127H1-t2-cl18long
DTICIGYHANNSTDTVDTVLEKNVTVTHSVNLLENGGGGKYVC

SAKLRMVTGLRNKPSKQSQGLFGAIAGFTEGGWTGMVDGWYGYHHQNEQGSGYAADQKST

QNAINGITNKVNSVIEKMNTQYTAIGCEYNKSERCMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

| SEQUENCES |
|---|

SEQ ID NO: 187: s127H1-t2-cl19long
DTICIGYHANNSTDTVDTVLEKNVTVTHSVNLLENGGGGKYVC

SAKLRMVTGLRNKPSKQSQGLFGAIAGFTEGGWTGMVDGWYGYHHQNEQGSGYAADQKST

QNAINCITNKVNSVIEKMNTQYTAIGKEYNKSERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 188: s127H1-t2-cl21long
DTICIGYHANNSTDTVDTVLECNVTVTHSVNLLENGGGGKYVC

SAKLRMVTGLRNKPSKQSQGLFGAIAGFTEGGWTGMVDGWYGYHHQNEQGSGYAADQKST

QNAINGITCKVNSVIEKMNTQYTAIGKEYNKSERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 189: s127H1-t2-cl22long
DTICIGYHANNSTDTVDTCLEKNVTVTHSVNLLENGGGGKYVC

SAKLRMVTGLRNKPSKQSQGLFGAIAGFTEGGWTGMVDGWYGYHHQNEQGSGYAADQKST

QNAINGITNCVNSVIEKMNTQYTAIGKEYNKSERRMKQIEDKIEEIESKIWCYNAELLVL

LENERTLDFHDSNVKNLYEKVKSQLKNNAKEIGNGCFEFYHKCNDECMESVKNGTYDYPK

YSEESKLNREKIDGVKLESMGVYQIEG

SEQ ID NO: 190: s127H1-t2-cl23long
DTICIGYHANNSTDTVDTVLEKNVTVTHSVNLLENGGGGKYVC

SAKLRMVTGLRNKPSKQCQGLFGAIAGFTEGGWTGMVDGWYGYHHQNEQGSGYAADQKST

QNAINGITNKVNSVIEKMNTQYTAIGKEYNKSERRMKQIEDKIEEIESKIWCYNAELLVL

LENERTLDFHDSNVKCLYEKVKSQLKNNAKEIGNGCFEFYHKCNDECMESVKNGTYDYPK

YSEESKLNREKIDGVKLESMGVYQIEG

SEQ ID NO: 191: s127H1-t2-cl24 long
DTICIGYHANNSTDTVDTVLEKNVTVTHSVNLLENGGGGKYVC

SAKLRMVTGLRNKPSKQSQCLFGAIAGFTEGGWTGMVDGWYGYHHQNEQGSGYAADQKST

QNAINGITNKVNSVIEKMNTQYTAIGKEYNKSERRMKQIEDKIEEIESKIWCYNAELLVL

LENERTLDFHDSNVKNLYEKVKCQLKNNAKEIGNGCFEFYHKCNDECMESVKNGTYDYPK

YSEESKLNREKIDGVKLESMGVYQIEG

SEQ ID NO: 192: s127H1-t2-cl24long
DTICIGYHANNSTDTVDTVLEKNVTVTHSVNLLENGGGGKYVC

SAKLRMVTGLRNKPSKQSQCLFGAIAGFTEGGWTGMVDGWYGYHHQNEQGSGYAADQKST

QNAINGITNKVNSVIEKMNTQYTAIGKEYNKSERRMKQIEDKIEEIESKIWCYNAELLVL

LENERTLDFHDSNVKNLYECVKSQLKNNAKEIGNGCFEFYHKCNDECMESVKNGTYDYPK

YSEESKLNREKIDGVKLESMGVYQIEG

SEQ ID NO: 193:
CMKQIEDKIEEIESK

SEQ ID NO: 194:
RMCQIEDKIEEIESKQK

SEQ ID NO: 195: smH1 Cali3964-55G7
MKAILVVLLYTFATANADTLCIGYHANNSTDTVDTVLEKNVTVTHSVNLLEDGGGGKYVCSTKLR

LATGLRNKPSNQSQGLFGAIAGYVEGGWTGMVDGWYGYHHQNEQGSGYAADLKSTQNAIDEITNK

| SEQUENCES |
| --- |

VNSVIEKMNTQYTAIGKEMNHLERMKQIEDKIEEIESKQIWCYNAELLVLLENERTLDYHDSNVK

NLYEKVRSQLKNNAKEIGNGCFEFYHKCDNTCMESVKNGTYDYPKYSEEAKLNREEIDGRSLVPR

GSPGHHHHHH

SEQ ID NO: 196: smH1 Cali3964-86B4
MKAILVVLLYTFATANADTLCIGYHANNSTDTVDTVLEKNVTVTHSVNLLEDGGGGKYVCSTKLR

LATGLRNKPSNQSQGLFGAIAGYKEGGWTGMVDGWYGYHHQNEQGSGYAADLKSTQNAIDEITNK

VNSVIEKMNTQFTAIGKEMNHIERMKQIEDKIEEIESKQIWCYNAELLVLLENERTLDYHDSNVK

NLYEKVRSQLKNNAKEIGNGCFEFYHKCDNTCMESVKNGTYDYPKYSEEAKLNREEIDGRSLVPR

GSPGHHHHHH

SEQ ID NO: 197: smH1 Cali3964-127H1
MKAILVVLLYTFATANADTLCIGYHANNSTDTVDTVLEKNVTVTHSVNLLEDGGGGKYVCSTKLR

LATGLRNKPSKQSQGLFGAIAGFTEGGWTGMVDGWYGYHHQNEQGSGYAADLKSTQNAIDEITNK

VNSVIEKMNTQYTAIGKEYNHSERMKQIEDKIEEIESKQIWCYNAELLVLLENERTLDYHDSNVK

NLYEKVRSQLKNNAKEIGNGCFEFYHKCDNTCMESVKNGTYDYPKYSEEAKLNREEIDGRSLVPR

GSPGHHHHHH

SEQ ID NO: 198: _smH1 Cali3964-55G7-t2
MKAILVVLLYTFATANADTLCIGYHANNSTDTVDTVLEKNVTVTHSVNLLEDGGGGKYVCSTKLR

LATGLRNKPSNQSQGLFGAIAGYVEGGWTGMVDGWYGYHHQNEQGSGYAADLKSTQNAIDEITNK

VNSVIEKMNTQYTAIGKEMNHLERRMKQIEDKIEEIESKIWCYNAELLVLLENERTLDYHDSNVK

NLYEKVRSQLKNNAKEIGNGCFEFYHKCDNTCMESVKNGTYDYPKYSEEAKLNREEIDGRSLVPR

GSPGHHHHHH

SEQ ID NO: 199: _smH1 Cali3964-86B4-t2
MKAILVVLLYTFATANADTLCIGYHANNSTDTVDTVLEKNVTVTHSVNLLEDGGGGKYVCSTKLR

LATGLRNKPSNQSQGLFGAIAGYKEGGWTGMVDGWYGYHHQNEQGSGYAADLKSTQNAIDEITNK

VNSVIEKMNTQFTAIGKEMNHIERRMKQIEDKIEEIESKIWCYNAELLVLLENERTLDYHDSNVK

NLYEKVRSQLKNNAKEIGNGCFEFYHKCDNTCMESVKNGTYDYPKYSEEAKLNREEIDGRSLVPR

GSPGHHHHHH

SEQ ID NO: 200: SmH1 Cali3964-127H1-t2
MKAILVVLLYTFATANADTLCIGYHANNSTDTVDTVLEKNVTVTHSVNLLEDGGGGKYVCSTKLR

LATGLRNKPSKQSQGLFGAIAGFTEGGWTGMVDGWYGYHHQNEQGSGYAADLKSTQNAIDEITNK

VNSVIEKMNTQYTAIGKEYNHSERRMKQIEDKIEEIESKIWCYNAELLVLLENERTLDYHDSNVK

NLYEKVRSQLKNNAKEIGNGCFEFYHKCDNTCMESVKNGTYDYPKYSEEAKLNREEIDGRSLVPR

GSPGHHHHHH

SEQ ID NO: 201: mH1 Cali3964-127H1-t2
MKAILWLLYTFATANADTLCIGYHANNSTDTVDTVLEKNVTVTHSVNLLEDGGGGKYVCSTKLR

LATGLRNKPSKQSQGLFGAIAGFTEGGWTGMVDGWYGYHHQNEQGSGYAADLKSTQNAIDEITNK

VNSVIEKMNTQYTAIGKEYNHSERRMKQIEDKIEEIESKIWCYNAELLVLLENERTLDYHDSNVK

NLYEKVRSQLKNNAKEIGNGCFEFYHKCDNTCMESVKNGTYDYPKYSEEAKLNREEIDGVKLEST

RIYQILAIYSTVASSLVLWSLGAISFWMCSNGSLQCRICI

SEQ ID NO: 202: mH1 Cali3964-127H1-t2-cl18
MKAILVVLLYTFATANADTLCIGYHANNSTDTVDTVLEKNVTVTHSVNLLEDGGGGKYVCSTKLR

LATGLRNKPSKQSQGLFGAIAGFTEGGWTGMVDGWYGYHHQNEQGSGYAADLKSTQNAIDEITNK

-continued

| SEQUENCES |
| --- |
| VNSVIEKMNTQYTAIGCEYNKSERCMKQIEDKIEEIESKIWCYNAELLVLLENERTLDYHDSNVK<br><br>NLYEKVRSQLKNNAKEIGNGCFEFYHKCDNTCMESVKNGTYDYPKYSEEAKLNREEIDGVKLEST<br><br>RIYQILAIYSTVASSLVLWSLGAISFWMCSNGSLQCRICI<br><br>SEQ ID NO: 203: smH1 Cali3964-127H1-t2-cl18long<br>DTLCIGYHANNSTDTVDTVLEKNVTVTHSVNLLEDGGGGKYVCSTKLRLATGLRNKPSKQSQGLF<br><br>GAIAGFTEGGWTGMVDGWYGYHHQNEQGSGYAADLKSTQNAIDEITNKVNSVIEKMNTQYTAIGC<br><br>EYNKSERCMKQIEDKIEEIESKIWCYNAELLVLLENERTLDYHDSNVKNLYEKVRSQLKNNAKEI<br><br>GNGCFEFYHKCDNTCMESVKNGTYDYPKYSEEAKLNREEIDGVKLESTRIYQIEG<br><br>SEQ ID NO: 204: FL HA H1N1 A/AA_Marton/43<br>MKARLLVLLC ALAATDADTI CIGYHANNST DTVDTVLEKN VTVTHSVNLL 050<br><br>EDSHNGKLCR LKGIAPLQLG KCNIAGWILG NPECESLLSE RSWSYIVETP 100<br><br>NSENGTCYPG DFIDYEELRE QLSSVSSFER FEIFSKESSW PKHNTTRGVT 150<br><br>AACSHAGKSS FYRNLLWLTE KDGSYPNLNN SYVNKKGKEV LVLWGVHHPS 200<br><br>NIKDQQTLYQ KENAYVSVVS SNYNRRFTPE IAERPKVRGQ AGRMNYYWTL 250<br><br>LKPGDTIMFE ANGNLIAPWY AFALSRGFGS GIITSNASMH ECDTKCQTPQ 300<br><br>GAINSSLPFQ NIHPVTIGEC PKYVRSTKLR MVTGLRNIPS IQSRGLFGAI 350<br><br>AGFIEGGWTG MIDGWYGYHH QNEQGSGYAA DQKSTQNAIN GITNKVNSVI 400<br><br>EKMNTQFTAV GKEFNNLEKR MENLNKKVDD GFLDIWTYNA ELLVLLENER 450<br><br>TLDFHDSNVK NLYEKVKNQL RNNAKEIGNG CFEFYHKCNN ECMESVKNGT 500<br><br>YDYPKYSEES KLNREKIDG V KLESMGVYQI LAIYSTVASS LVLLVSLGAI 550<br><br>SFWMCSNGSL QCRICI 565<br><br>SEQ ID NO: 205: FL HA H1N1 A/Texas/UR06-0526/07<br>MKVKLLVLLC TFTATYADTI CIGYHANNST DTVDTVLEKN VTVTHSVNLL 050<br><br>EDSHNGKLCL LKGTAPLQLG NCSVAGWILG NPECELLISK ESWSYIVETP 100<br><br>NPENGTCYPG YFADYEELRE QLSSVSSFER FEIFPKESSW PNHTVTGVSA 150<br><br>SCSHNGKSSF YRNLLWLTGK NGLYPNLSKS YANNKEKEVL VLWGVHHPPN 200<br><br>IGDQRALYHT ENAYVSVVSS HYSRRFTPEI AKRPKVRDQE GRINYYWTLL 250<br><br>EPGDTIIFEA NGNLIAPRFA FALSRGFGSG IITSNAPMGE CDAKCQTPQG 300<br><br>AINSSLPFQN VHPVTIGECP KYVRSAKLRM VTGLRNIPSI QSRGLFGAIA 350<br><br>GFIEGGWTGM VDGWYGYHHQ NEQGSGYAAD QKSTQNAING ITNKVNSVIE 400<br><br>KMNTQFTAVG KEFNKLERRM ENLNKKVDDG FLDIWTYNAE LLVLLENERT 450<br><br>LDFHDSNVKN LYEKVKNQLK NNAKEIGNGC FEFYHKCNDE CMESVKNGTY 500<br><br>DYPKYSEESK LNREKIDGVK LESMGVYQIL AIYSTVASSL VLLISLGAIS 550<br><br>FWMCSNGSLQ CRICI 565<br><br>SEQ ID NO: 206: H1N1 A/New York/629/95<br>MKVKLLVLLC AFTATYADTI CIGYHANNST DTVDTVLEKN VTVTHSVNLL 050<br><br>EDSHNGKLCR LKGTAPLQLG NCSVAGWILG NPECESLFSK ESWSYIAETP 100<br><br>NPENGTCYPG YFADYEELRE QLSSVSSFER FEIFPKESSW PNHTVTKGVT 150<br><br>ASCSHNGKSS FYKNLLWLTE KNGLYPNLSK SYVNNKEKEV LVLWGVHHPS 200<br><br>NIGDQRAIYH TENAYVSVVS SHYSRRFTPE IAKRPKVRDQ EGRINYYWTL 250 |

| SEQUENCES | |
|---|---|
| LEPGDTIIFE ANGNLIAPWY AFALSRGFGS GIITSNASMS ECDAKCQTPQ | 300 |
| GAINSSLPFQ NVHPVTIGEC PKYVRSTKLR MVTGLRNIPS IQSRGLFGAI | 350 |
| AGFIEGGWTG MIDGWYGYHH QNEQGSGYAA DQKSTQNAID GITNKVNSVI | 400 |
| EKMNTQFTAV GKEFNKLERR MENLNKKVDD GFLDIWTYNA ELLVLLENER | 450 |
| TLDFHDSNVK NLYEKVKNQL KNNAKEIGNG CFEFYHKCNN ECMESVKNGT | 500 |
| YDYPKYSEES KLNREKIDGV KLESMGVYQI LAIYSTVASS LVLLVSLGAI | 550 |
| SFWMCSNGSL QCRICI | 566 |

SEQ ID NO: 207: H1 mini Texas 127H1_t2 + cl18
MKVKLLVLLCTFTATYADTICIGYHANNSTDTVDTVLEKNVTVTHSVNLLEDGGGGKYVCSAKLR

MVTGLRNKPSKQSQGLFGAIAGFTEGGWTGMVDGWYGYHHQNEQGSGYAADQKSTQNAINGITNK

VNSVIEKMNTQYTAIGCEYNKSERCMKQIEDKIEEIESKIWCYNAELLVLLENERTLDFHDSNVK

NLYEKVKNQLKNNAKEIGNGCFEFYHKCNDECMESVKNGTYDYPKYSEESKLNREKIDGVKLESM

GVYQILAIYSTVASSLVLLISLGAISFWMCSNGSLQCRICI

SEQ ID NO: 208: #5123_sH1 mini Texas 127H1_t2 + cl18
DTICIGYHANNSTDTVDTVLEKNVTVTHSVNLLEDGGGGKYVCSAKLRMVTGLRNKPSKQSQGLF

GAIAGFTEGGWTGMVDGWYGYHHQNEQGSGYAADQKSTQNAINGITNKVNSVIEKMNTQYTAIGC

EYNKSERCMKQIEDKIEEIESKIWCYNAELLVLLENERTLDFHDSNVKNLYEKVKNQLKNNAKEI

GNGCFEFYHKCNDECMESVKNGTYDYPKYSEESKLNREKIDGVKLESMGVYQI

SEQ ID NO: 209: H1 mini NY 127H1_t2 + cl18
MKAKLLVLLCAFTATYADTICIGYHANNSTDTVDTVLEKNVTVTHSVNLLEDGGGGKYVCSTKLR

MVTGLRNKPSKQSQGLFGAIAGFTEGGWTGMIDGWYGYHHQNEQGSGYAADQKSTQNAIDGITNK

VNSVIEKMNTQYTAIGCEYNKSERCMKQIEDKIEEIESKIWCYNAELLVLLENERTLDFHDSNVK

NLYEKVKTQLKNNAKEIGNGCFEFYHKCNNECMESVKNGTYDYPKYSEESKLNREKIDGVKLESM

GVYQI LAIYSTVASSLVLLVSLGAISFWMCSNGSLQCRICI

SEQ ID NO: 210: #5124_sH1 mini NY 127H1_t2 + cl18
DTICIGYHANNSTDTVDTVLEKNVTVTHSVNLLEDGGGGKYVCSTKLRMVTGLRNKPSKQSQGLF

GAIAGFTEGGWTGMIDGWYGYHHQNEQGSGYAADQKSTQNAIDGITNKVNSVIEKMNTQYTAIGC

EYNKSERCMKQIEDKIEEIESKIWCYNAELLVLLENERTLDFHDSNVKNLYEKVKTQLKNNAKEI

GNGCFEFYHKCNNECMESVKNGTYDYPKYSEESKLNREKIDGVKLESMGVYQI

SEQ ID NO: 211: H1 mini Cal 127H1_t2 + cl18
MKAILVVLLYTFATANADTLCIGYHANNSTDTVDTVLEKNVTVTHSVNLLEDGGGGKYVCSTKLR

LATGLRNKPSKQSQGLFGAIAGFTEGGWTGMVDGWYGYHHQNEQGSGYAADLKSTQNAIDEITNK

VNSVIEKMNTQYTAIGCEYNHSERCMKQIEDKIEEIESKIWCYNAELLVLLENERTLDYHDSNVK

NLYEKVRSQLKNNAKEIGNGCFEFYHKCDNTCMESVKNGTYDYPKYSEEAKLNREEIDGVKLEST

RIYQILAIYSTVASSLVLWSLGAISFWMCSNGSLQCRICI

SEQ ID NO: 212: sH1 mini Cal 127H1_t2 + cl18
DTLCIGYHANNSTDTVDTVLEKNVTVTHSVNLLEDGGGGKYVCSTKLRLATGLRNKPSKQSQGLF

GAIAGFTEGGWTGMVDGWYGYHHQNEQGSGYAADLKSTQNAIDEITNKVNSVIEKMNTQYTAIGC

EYNHSERCMKQIEDKIEEIESKIWCYNAELLVLLENERTLDYHDSNVKNLYEKVRSQLKNNAKEI

GNGCFEFYHKCDNTCMESVKNGTYDYPKYSEEAKLNREEIDGVKLESTRIYQI

-continued

| SEQUENCES |
|---|

SEQ ID NO: 213: H1 mini Mart 127H1_t2 + cl18 + loop
MKARLLVLLCALAATDADTICIGYHANNSTDTVDTVLEKNVTVTHSVNLLEDGGGGKYVCSTKLR

MVTGLRNKPSKQSQGLFGAIAGFTEGGWTGMIDGWYGYHHQNEQGSGYAADQKSTQNAINGITNK

VNSVIEKMNTQYTAIGCEYNKSERCMKQIEDKIEEIESKIWCYNAELLVLLENERTLDFHDSNVK

NLYEKVKNQLRNNAKEIGNGCFEFYHKCNNECMESVKNGTYDYPKYSEESKLNREKIDGVKLESM

GVYQILAIYSTVASSLVLLVSLGAISFWMCSNGSLQCRICI

SEQ ID NO: 214: #5126 SH1 mini Mart 127H1_t2 + Cl18 + loop
DTICIGYHANNSTDTVDTVLEKNVTVTHSVNLLEDGGGGKYVCSTKLRMVTGLRNKPSKQSQGLF

GAIAGFTEGGWTGMIDGWYGYHHQNEQGSGYAADQKSTQNAINGITNKVNSVIEKMNTQYTAIGC

EYNKSERCMKQIEDKIEEIESKIWCYNAELLVLLENERTLDFHDSNVKNLYEKVKNQLRNNAKEI

GNGCFEFYHKCNNECMESVKNGTYDYPKYSEESKLNREKIDGVKLESMGVYQI

SEQ ID NO: 215: H1 mini Mart 127H1_t2 + cl18
MKARLLVLLCALAATDADTICIGYHANNSTDTVDTVLEKNVTVTHSVNLLEDGGGGKYVCSTKLR

MVTGLRNKPSKQSQGLFGAIAGFTEGGWTGMIDGWYGYHHQNEQGSGYAADQKSTQNAINGITNK

VNSVIEKMNTQYTAIGCEYNNSERCMKQIEDKIEEIESKIWCYNAELLVLLENERTLDFHDSNVK

NLYEKVKNQLRNNAKEIGNGCFEFYHKCNNECMESVKNGTYDYPKYSEESKLNREKIDGVKLESM

GVYQILAIYSTVASSLVLLVSLGAISFWMCSNGSLQCRICI

SEQ ID NO: 216: sH1 mini Mart 127H1_t2 + cl18
MKARLLVLLCALAATDADTICIGYHANNSTDTVDTVLEKNVTVTHSVNLLEDGGGGKYVCSTKLR

MVTGLRNKPSKQSQGLFGAIAGFTEGGWTGMIDGWYGYHHQNEQGSGYAADQKSTQNAINGITNK

VNSVIEKMNTQYTAIGCEYNNSERCMKQIEDKIEEIESKIWCYNAELLVLLENERTLDFHDSNVK

NLYEKVKNQLRNNAKEIGNGCFEFYHKCNNECMESVKNGTYDYPKYSEESKLNREKIDGVKLESM

GVYQ

SEQ ID NO: 217: FL HA H2N2 A/Adachi/2/57
MAIIYLILLF TAVRGDQICI GYHANNSTEK VDTILERNVT VTHAKDILEK 050

THNGKLCKLN GIPPLELGDC SIAGWLLGNP ECDRLLSVPE WSYIMEKENP 100

RNGLCYPGSF NDYEELKHLL SSVKHFEKVK ILPKDRWTQH TTTGGSQACA 150

VSGNPSFFRN MVWLTKKGSD YPVAKGSYNN TSGEQMLIIW GVHHPIDETE 200

QRTLYQNVGT YVSVGTSTLN KRSTPEIATR PKVNGLGSRM EFSWTLLDMW 250

DTINFESTGN LIAPEYGFKI SKRGSSGIMK TEGTLENCET KCQTPLGAIN 300

TTLPFHNVHP LTIGECPKYV KSEKLVLATG LRNVPQIESR GLFGAIAGFI 350

EGGWQGMVDG WYGYHHSNDQ GSGYAADKES TQKAFDGITN KVNSVIEKMN 400

TQFEAVGKEF GNLERRLENL NKKMEDGFLD VWTYNAELLV LMENERTLDF 450

HDSNVKNLYD KVRMQLRDNV KELGNGCFEF YHKCDDECMN SVKNGTYDYP 500

KYEEESKLNR NEIKGVKLSS MGVYQI LAIY ATVAGSLSLA IMMAGISFWM 550

CSNGSLQCRI CI 562

SEQ ID NO: 218: H2 mini Adachi 127H1_t2 + cl18
MAIIYLILLFTAVRGDQICIGYHANNSTEKVDTILERNVTVTHAKDILENGGGGKYVCSEKLVLA

TGLRNKPQKESQGLFGAIAGFTEGGWQGMVDGWYGYHHSNDQGSGYAADKESTQKAFDGITNKVN

SVIEKMNTQYEATGCEYGNLERCMKQIEDKIEEIESKIWCYNAELLVLMENERTLDFHDSNVKNL

YDKVRMQLRDNVKELGNGCFEFYHKCDDECMNSVKNGTYDYPKYEEESKLNRNEIKGVKLSSMGV

YQI LAIYATVAGSLSLAIMMAGISFWMCSNGSLQCRICI

| SEQUENCES |
|---|

SEQ ID NO: 219: H2 mini Adachi 127H1_t2 + cl18 + loop
MAIIYLILLFTAVRGDQICIGYHANNSTEKVDTILERNVTVTHAKDILENGGGGKYVCSEKLVLA

TGLRNKPQKESQGLFGAIAGFTEGGWQGMVDGWYGYHHSNDQGSGYAADKESTQKAFDGITNKVN

SVIEKMNTQYTAYGCEYNKSERCMKQIEDKIEEIESKIWCYNAELLVLMENERTLDFHDSNVKNL

YDKVRMQLRDNVKELGNGCFEFYHKCDDECMNSVKNGTYDYPKYEEESKLRNEIKGVKLSSMGV

YQILAIYATVAGSLSLAIMMAGISFWMCSNGSLQCRICI

SEQ ID NO: 220: #5119 sH2 mini Adachi 127H1_t2 + cl18
DQICIGYHANNSTEKVDTILERNVTVTHAKDILENGGGGKYVCSEKLVLATGLRNKPQKESQGLF

GAIAGFTEGGWQGMVDGWYGYHHSNDQGSGYAADKESTQKAFDGITNKVNSVIEKMNTQYEATGC

EYGNLERCMKQIEDKIEEIESKIWCYNAELLVLMENERTLDFHDSNVKNLYDKVRMQLRDNVKEL

GNGCFEFYHKCDDECMNSVKNGTYDYPKYEEESKLRNEIKGVKLSSMGVYQI

SEQ ID NO: 221: #5120 sH2 mini Adachi 127H1_t2 + cl18 + loop
DQICIGYHANNSTEKVDTILERNVTVTHAKDILENGGGGKYVCSEKLVLATGLRNKPQKESQGLF

GAIAGFTEGGWQGMVDGWYGYHHSNDQGSGYAADKESTQKAFDGITNKVNSVIEKMNTQYTAYGC

EYNKSERCMKQIEDKIEEIESKIWCYNAELLVLMENERTLDFHDSNVKNLYDKVRMQLRDNVKEL

GNGCFEFYHKCDDECMNSVKNGTYDYPKYEEESKLRNEIKGVKLSSMGVYQI

SEQ ID NO: 222: FL HA H2N2 A/Singapore/1/1957
| MAIIYLILLF | TAVRGDQICI | GYHANNSTEK | VDTILERNVT | VTHAKDILEK | 050 |
| TH

| SEQUENCES |
|---|
| SEQ ID NO: 225: #5121 sH2 mini Sing 127H1_t2 + cl18<br>DQICIGYHANNSTEKVDTILERNVTVTHAKDILENGGGGKYVCSEKLVLATGLRNKPQKESQGLF<br>GAIAGFTEGGWQGMVDGWYGYHHSNDQGSGYAADKESTQKAFDGITNKVNSVIEKMNTQYEAIGC<br>EYSNLERCMKQIEDKIEEIESKIWCYNAELLVLMENERTLDFHDSNVKNLYDKVRMQLRDNVKEL<br>GNGCFEFYHKCDDECMNSVKNGTYDYPKYEEESKLNRNEIKGVKLSSMGVYQI |
| SEQ ID NO: 226: #5122 sH2 mini Sing 127H1_t2 + cl18 + loop<br>DQICIGYHANNSTEKVDTILERNVTVTHAKDILENGGGGKYVCSEKLVLATGLRNKPQKESQGLF<br>GAIAGFTEGGWQGMVDGWYGYHHSNDQGSGYAADKESTQKAFDGITNKVNSVIEKMNTQYTAIGC<br>EYNKSERCMKQIEDKIEEIESKIWCYNAELLVLMENERTLDFHDSNVKNLYDKVRMQLRDNVKEL<br>GNGCFEFYHKCDDECMNSVKNGTYDYPKYEEESKLNRNEIKGVKLSSMGVYQI |
| SEQ ID NO: 227: FL HA H5N1 A/Vietnam/1203/2004<br>MEKIVLLFAIVSLVKSDQICIGYHANNSTEQVDTIMEKNVTVTHAQDILEKKHNGKLCDLDGVKP<br>LILRDCSVAGWLLGNPMCDEFINVPEWSYIVEKANPVNDLCYPGDFNDYEELKHLLSRINHFEKI<br>QIIPKSSWSSHEASLGVSSACPYQGKSSFFRNVVWLIKKNSTYPTIKRSYNNTNQEDLLVLWGIH<br>HPNDAAEQTKLYQNPTTYISVGTSTLNQRLVPRIATRSKVNGQSGRMEFFWTILKPNDAINFESN<br>GNFIAPEYAYKIVKKGDSTIMKSELEYGNCNTKCQTPMGAINSSMPFHNIHPLTIGECPKYVKSN<br>RLVLATGLRNSPQRERRRKTRGLFGAIAGFIEGGWQGMVDGWYGYHHSNEQGSGYAADKESTQKA<br>IDGVTNKVNSIIDKMNTQFEAVGREFNNLERRIENLNKKMEDGFLDVWTYNAELLVLMENERTLD<br>FHDSNVKNLYDKVRLQLRDNAKELGNGCFEFYHKCDNECMESVRNGTYDYPQYSEEARLKREEIS<br>GVKLESIGIYQILSIYSTVASSLALAIMVAGLSLWMCSNGSLQCRICI |
| SEQ ID NO: 228: H5 mini VN/1203/2004<br>MEKIVLLFAIVSLVKSDQICIGYHANNSTEQVDTIMEKNVTVTHAQDILEKGGGGKYVCSNRLVL<br>ATGLRNKPQKESQGLFGAIAGFTEGGWQGMVDGWYGYHHSNEQGSGYAADKESTQKAIDGVTNKV<br>NSIIDKMNTQYEAIGCEYNNSERCMKQIEDKIEEIESKIWCYNAELLVLMENERTLDFHDSNVKN<br>LYDKVRLQLRDNAKELGNGCFEFYHKCDNECMESVRNGTYDYPQYSEEARLKREEISGVKLESIG<br>IYQILSIYSTVASSLALAIMVAGLSLWMCSNGSLQCRICI |
| SEQ ID NO: 229: sH5 mini VN/1203/2004<br>DQICIGYHANNSTEQVDTIMEKNVTVTHAQDILEKGGGGKYVCSNRLVLATGLRNKPQKESQGLF<br>GAIAGFTEGGWQGMVDGWYGYHHSNEQGSGYAADKESTQKAIDGVTNKVNSIIDKMNTQYEAIGC<br>EYNNSERCMKQIEDKIEEIESKIWCYNAELLVLMENERTLDFHDSNVKNLYDKVRLQLRDNAKEL<br>GNGCFEFYHKCDNECMESVRNGTYDYPQYSEEARLKREEISGVKLESIGIYQI |
| SEQ ID NO: 230: H5 mini VN/1203/2004 + loop<br>MEKIVLLFAIVSLVKSDQICIGYHANNSTEQVDTIMEKNVTVTHAQDILEKGGGGKYVCSNRLVL<br>ATGLRNKPQKESQGLFGAIAGFTEGGWQGMVDGWYGYHHSNEQGSGYAADKESTQKAIDGVTNKV<br>NSIIDKMNTQYTAIGCEYNKSERCMKQIEDKIEEIESKIWCYNAELLVLMENERTLDFHDSNVKN<br>LYDKVRLQLRDNAKELGNGCFEFYHKCDNECMESVRNGTYDYPQYSEEARLKREEISGVKLESIG<br>IYQILSIYSTVASSLALAIMVAGLSLWMCSNGSLQCRICI |
| SEQ ID NO: 231: sH5 mini VN/1203/2004 + loop<br>DQICIGYHANNSTEQVDTIMEKNVTVTHAQDILEKGGGGKYVCSNRLVLATGLRNKPQKESQGLF<br>GAIAGFTEGGWQGMVDGWYGYHHSNEQGSGYAADKESTQKAIDGVTNKVNSIIDKMNTQYTAIGC<br>EYNKSERCMKQIEDKIEEIESKIWCYNAELLVLMENERTLDFHDSNVKNLYDKVRLQLRDNAKEL<br>GNGCFEFYHKCDNECMESVRNGTYDYPQYSEEARLKREEISGVKLESIGIYQI |

-continued

| SEQUENCES |
|---|
| SEQ ID NO: 232: FL HA H9N2 A/Hong_Kong/69955/2008<br>METVSLITMLLVATVINADKICIGYQSTNSTETVDTLTENNVPVTHAKELLHTEHNGMLCATNLG<br>YPLILDTCTIEGLIYGNPSCDLLLGGREWSYIVERPSAVNGLCYPGNVENLEELRSLFSSASSYQ<br>RIQIFPDTIWNVSYSGTSKACSDSFYRSMRWLTQKNNAYPIQDAQYTNNREKNILFMWGINHPPT<br>DTAQTNLYTRTDTTTSVATEEINRTFKPLIGPRPLVNGLQGRIDYYWSVLKPGQTLRIRSNGNLI<br>APWYGHILSGESHGRILKTDLKRGSCTVQCQTEKGGLNTTLPFQNVSKYAFGNCSKYVGVKSLKL<br>AVGLRNVPSRSSRGLFGAIAGFIEGGWSGLVAGWYGFQHSNDQGVGMAADRDSTQKAIDKITSKV<br>NNIVDKMNKQYEIIDHEFSEVETRLNMINNKIDDQIQDIWAYNAELLVLLENQKTLDEHDANVNN<br>LYNKVKRALGSNAVEDGKGCFELYHKCDDQCMETIRNGTYNRRRYQEESKLERQKIEGVKLESEG<br>TYKILTIYSTVASSLVIAMGFAAFLFWAMSNGSCRCNICI |
| SEQ ID NO: 233: H9 mini HK/69955/2009<br>METVSLITMLLVATVINADKICIGYQSTNSTETVDTLTENNVPVTHAKELLHGGGGKYVCVKSLK<br>LAVGLRNKPSKSSQGLFGAIAGFTEGGWSGLVAGWYGFQHSNDQGVGMAADRDSTQKAIDKITSK<br>VNNIVDKMNKQYEIIDCEYSESERCMKQIEDKIEEIESKIWCYNAELLVLLENQKTLDEHDANVN<br>NLYNKVKRALGSNAVEDGKGCFELYHKCDDQCMETIRNGTYNRRRYQEESKLERQKIEGVKLESE<br>GTYKILTIYSTVASSLVIAMGFAAFLFWAMSNGSCRCNICI |
| SEQ ID NO: 234: sH9 mini HK/69955/2009<br>DKICIGYQSTNSTETVDTLTENNVPVTHAKELLHGGGGKYVCVKSLKLAVGLRNKPSKSSQGLFG<br>AIAGFTEGGWSGLVAGWYGFQHSNDQGVGMAADRDSTQKAIDKITSKVNNIVDKMNKQYEIIDCE<br>YSESERCMKQIEDKIEEIESKIWCYNAELLVLLENQKTLDEHDANVNNLYNKVKRALGSNAVEDG<br>KGCFELYHKCDDQCMETIRNGTYNRRRYQEESKLERQKIEGVKLESEGTYKI |
| SEQ ID NO: 235: H9 mini HK/69955/2009 + loop<br>METVSLITMLLVATVINADKICIGYQSTNSTETVDTLTENNVPVTHAKELLHGGGGKYVCVKSLK<br>LAVGLRNKPSKSSQGLFGAIAGFTEGGWSGLVAGWYGFQHSNDQGVGMAADRDSTQKAIDKITSK<br>VNNIVDKMNTQYTAIGCEYNKSERCMKQIEDKIEEIESKIWCYNAELLVLLENQKTLDEHDANVN<br>NLYNKVKRALGSNAVEDGKGCFELYHKCDDQCMETIRNGTYNRRRYQEESKLERQKIEGVKLESE<br>GTYKILTIYSTVASSLVIAMGFAAFLFWAMSNGSCRCNICI |
| SEQ ID NO: 236: sH9 mini HK/69955/2009 + loop<br>DKICIGYQSTNSTETVDTLTENNVPVTHAKELLHGGGGKYVCVKSLKLAVGLRNKPSKSSQGLFG<br>AIAGFTEGGWSGLVAGWYGFQHSNDQGVGMAADRDSTQKAIDKITSKVNNIVDKMNTQYTAIGCE<br>YNKSERCMKQIEDKIEEIESKIWCYNAELLVLLENQKTLDEHDANVNNLYNKVKRALGSNAVEDG<br>KGCFELYHKCDDQCMETIRNGTYNRRRYQEESKLERQKIEGVKLESEGTYKI |
| SEQ ID NO: 237: Full length HA H3N2 A/Hong Kong/1/1968<br>MKTIIALSYIFCLALGQDLPGNDNSTATLCLGHHAVPNGTLVKTITDDQIEVTNATELVQSSSTG<br>KICNNPHRILDGIDCTLIDALLGDPHCDVFQNETWDLFVERSKAFSNCYPYDVPDYASLRSLVAS<br>SGTLEFITEGFTWTGVTQNGGSNACKRGPGSGFFSRLNWLTKSGSTYPVLNVTMPNNDNFDKLYI<br>WGVHHPSTNQEQTSLYVQASGRVTVSTRRSQQTIIPNIGSRPWVRGLSSRISIYWTIVKPGDVLV<br>INSNGNLIAPRGYFKMRTGKSSIMRSDAPIDTCISECITPNGSIPNDKPFQNVNKITYGACPKYV<br>KQNTLKLATGMRNVPEKQTRGLFGAIAGFIENGWEGMIDGWYGFRHQNSEGTGQAADLKSTQAAI<br>DQINGKLNRVIEKTNEKFHQIEKEFSEVEGRIQDLEKYVEDTKIDLWSYNAELLVALENQHTIDL<br>TDSEMNKLFEKTRRQLRENAEDMGNGCFKIYHKCDNACIESIRNGTYDHDVYRDEALNNRFQIKG<br>VELKSGYKDWILWISFAISCFLLCWLLGFIMWACQRGNIRCNICI |

| SEQUENCES |
| --- |

SEQ ID NO: 238: #2999 H3 HK68 mini2-cl9 + 10 + 11 + 12-GCN4t
MKTIIALSYIFCLALGQDLPGNDNSTATLCLGHHAVPNGTLVKTITDDQIEVTNATELVQSGGGG

KYVCQNTLKLATGMRNVPEKQTQGLFGAIAGFIENGWEGMIDGWYGFRHQNSEGTGQAADLKSTQ

AAIDQINGKLNRVREKTNEKSHQTEKESSEGEGRMKQIEDKIEEIESKLWCYNAELLVALENQHT

IDLTDSEMNKLFEKTRRQLRENAEDMGNGCFKIYHKCDNACIESIRNGTYDHDVYRDEALNNRFQ

IKGVELKSGYKDWILWISFAISCFLLCWLLGFIMWACQRGNIRCNICI

SEQ ID NO: 239: #3801 H3 HK mini2a-linker + cl9 + 10 + 11 + 12 +
GCN4T-CG7-1
MKTIIALSYIFCLALGQDLPGNDNSTATLCLGHHAVPNGTLVKTITDDQIEVTNATELVQSGGGG

KYVCQNTLKLATGMRNVPEKQTQGLFGAIAGFIENGWEGMIDGWYGFRHQNSEGTGQAADLKSTQ

AAIDQINGKLNRVREKTNEKSHQTEKESSNATGRMKQIEDKIEEIESKLWCYNAELLVALENQHT

IDLTDSEMNKLFEKTRRQLRENAEDMGNGCFKIYHKCDNACIESIRNGTYDHDVYRDEALNNRFQ

IKGVELKSGYKDWILWISFAISCFLLCWLLGFIMWACQRGNIRCNICI

SEQ ID NO: 240: #2999-cl14
MKTIIALSYIFCLALGQDLPGNDNSTATLCLGHHAVPNGTLVKTITDDQIEVTNATELVQSGGGG

KYVCQNTLKLATGMRNVPEKQTQGLFGAIAGFIENGWEGMIDGWYGFRHQNSEGTGQAADLKSTQ

AAIDQINGKLNRVREKTNEKSHQTEKESSEGEGRMKQCCDKIEEIESKLWCYNAELLVALENQHT

IDLTDSEMNKLFEKTRRQLRENAEDMGNGCFKIYHKCDNACIESIRNGTYDHDVYRDEALNNRFQ

IKGVELKSGYKDWILWISFAISCFLLCWLLGFIMWACQRGNIRCNICI

SEQ ID NO: 241: #2999 cl15
MKTIIALSYIFCLALGQDLPGNDNSTATLCLGHHAVPNGTLVKTITDDQIEVTNATELVQSGGGG

KYVCQNTLKLATGMRNVPEKQTQGLFGAIAGFIENGWEGMIDGWYGFRHQNSEGTGQAADLKSTQ

AAIDQINGKLNRVREKTNEKSHQTEKESSEGEGRMKQIEDKIEECCSKLWCYNAELLVALENQHT

IDLTDSEMNKLFEKTRRQLRENAEDMGNGCFKIYHKCDNACIESIRNGTYDHDVYRDEALNNRFQ

IKGVELKSGYKDWILWISFAISCFLLCWLLGFIMWACQRGNIRCNICI

SEQ ID NO: 242: #2999 cl17
MKTIIALSYIFCLALGQDLPGNDNSTATLCLGHHAVPNGTLVKTITDDQIEVTNATELVQSGGGG

KYVCQNTLKLATGMRNVPEKQTQGLFGAIAGFIENGWEGMIDGWYGFRHQNSEGTGQAADLKSTQ

AAIDQINGKLNRVREKTNECSHQTEKESSEGEGRMKQIEDKIECIESKLWCYNAELLVALENQHT

IDLTDSEMNKLFEKTRRQLRENAEDMGNGCFKIYHKCDNACIESIRNGTYDHDVYRDEALNNRFQ

IKGVELKSGYKDWILWISFAISCFLLCWLLGFIMWACQRGNIRCNICI

SEQ ID NO: 243: #2999 cl18
MKTIIALSYIFCLALGQDLPGNDNSTATLCLGHHAVPNGTLVKTITDDQIEVTNATELVQSGGGG

KYVCQNTLKLATGMRNVPEKQTQGLFGAIAGFIENGWEGMIDGWYGFRHQNSEGTGQAADLKSTQ

AAIDQINGKLNRVREKTNEKSHQTECESSEGEGCMKQIEDKIEEIESKLWCYNAELLVALENQHT

IDLTDSEMNKLFEKTRRQLRENAEDMGNGCFKIYHKCDNACIESIRNGTYDHDVYRDEALNNRFQ

IKGVELKSGYKDWILWISFAISCFLLCWLLGFIMWACQRGNIRCNICI

SEQ ID NO: 244: #2999 cl30
MKTIIALSYIFCLALGQDLPGNDNSTATLCLGHHAVPNGTLVKTITDDQIEVTNATELVQSGGGG

KYVCQNTLKLATGMRNVPEKQTQGLFGAIAGFIENGWEGMIDGWYGFRHQNSEGTGQAADLKSTQ

| SEQUENCES |
|---|
| AAIDQINGKLNRVREKTNEKSHCTEKESSEGEGRMKQIEDCIEEIESKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 245: #2999 cl31 |
| MKTIIALSYIFCLALGQDLPGNDNSTATLCLGHHAVPNGTLVKTITDDQIEVTNATELVQSGGGG |
| KYVCQNTLKLATGMRNVPEKQTQGLFGAIAGFIENGWEGMIDGWYGFRHQNSEGTGQAADLKSTQ |
| AAIDQINGKLNRVREKTNEKSHQCEKESSEGEGRMKQIEDCIEEIESKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 246: #3801-cl14 |
| MKTIIALSYIFCLALGQDLPGNDNSTATLCLGHHAVPNGTLVKTITDDQIEVTNATELVQSGGGG |
| KYVCQNTLKLATGMRNVPEKQTQGLFGAIAGFIENGWEGMIDGWYGFRHQNSEGTGQAADLKSTQ |
| AAIDQINGKLNRVREKTNEKSHQTEKESSNATGRMKQCCDKIEEIESKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 247: #3801 cl15 |
| MKTIIALSYIFCLALGQDLPGNDNSTATLCLGHHAVPNGTLVKTITDDQIEVTNATELVQSGGGG |
| KYVCQNTLKLATGMRNVPEKQTQGLFGAIAGFIENGWEGMIDGWYGFRHQNSEGTGQAADLKSTQ |
| AAIDQINGKLNRVREKTNEKSHQTEKESSNATGRMKQIEDKIEECCSKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 248: #3801 cl17 |
| MKTIIALSYIFCLALGQDLPGNDNSTATLCLGHHAVPNGTLVKTITDDQIEVTNATELVQSGGGG |
| KYVCQNTLKLATGMRNVPEKQTQGLFGAIAGFIENGWEGMIDGWYGFRHQNSEGTGQAADLKSTQ |
| AAIDQINGKLNRVREKTNECSHQTEKESSNATGRMKQIEDKIECIESKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 249: #3801 cl18 |
| MKTIIALSYIFCLALGQDLPGNDNSTATLCLGHHAVPNGTLVKTITDDQIEVTNATELVQSGGGG |
| KYVCQNTLKLATGMRNVPEKQTQGLFGAIAGFIENGWEGMIDGWYGFRHQNSEGTGQAADLKSTQ |
| AAIDQINGKLNRVREKTNEKSHQTECESSNATGCMKQIEDKIEEIESKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 250: #3801 cl30 |
| MKTIIALSYIFCLALGQDLPGNDNSTATLCLGHHAVPNGTLVKTITDDQIEVTNATELVQSGGGG |
| KYVCQNTLKLATGMRNVPEKQTQGLFGAIAGFIENGWEGMIDGWYGFRHQNSEGTGQAADLKSTQ |
| AAIDQINGKLNRVREKTNEKSHCTEKESSNATGRMKQIEDCIEEIESKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 251: #3801 cl31 |
| MKTIIALSYIFCLALGQDLPGNDNSTATLCLGHHAVPNGTLVKTITDDQIEVTNATELVQSGGGG |
| KYVCQNTLKLATGMRNVPEKQTQGLFGAIAGFIENGWEGMIDGWYGFRHQNSEGTGQAADLKSTQ |

-continued

| SEQUENCES |
| --- |
| AAIDQINGKLNRVREKTNEKSHQCEKESSNATGRMKQIEDCIEEIESKLWCYNAELLVALENQHT |
| IDLTDSEMNKLFEKTRRQLRENAEDMGNGCFKIYHKCDNACIESIRNGTYDHDVYRDEALNNRFQ |
| IKGVELKSGYKDWILWISFAISCFLLCWLLGFIMWACQRGNIRCNICI |
| SEQ ID NO: 252: _FL HA H1N1 A/California/07/2009<br>MKAILVVLLYTFATANADTLCIGYHANNSTDTVDTVLEKNVTVTHSVNLLEDKHNGKLCKLRGVA |
| PLHLGKCNIAGWILGNPECESLSTASSWSYIVETPSSDNGTCYPGDFIDYEELREQLSSVSSFER |
| FEIFPKTSSWPNHDSNKGVTAACPHAGAKSFYKNLIWLVKKGNSYPKLSKSYINDKGKEVLVLWG |
| IHHPSTSADQQSLYQNADAYVFVGSSRYSKKFKPEIAIRPKVRDQEGRMNYYWTLVEPGDKITFE |
| ATGNLVVPRYAFAMERNAGSGIIISDTPVHDCNTTCQTPKGAINTSLPFQNIHPITIGKCPKYVK |
| STKLRLATGLRNIPSIQSRGLFGAIAGFIEGGWTGMVDGWYGYHHQNEQGSGYAADLKSTQNAID |
| EITNKVNSVIEKMNTQFTAVGKEFNHLEKRIENLNKKVDDGFLDIWTYNAELLVLLENERTLDYH |
| DSNVKNLYEKVRSQLKNNAKEIGNGCFEFYHKCDNTCMESVKNGTYDYPKYSEEAKLNREEIDGV |
| KLESTRIYQILAIYSTVASSLVLVVSLGAISFWMCSNGSLQCRICI |
| SEQ ID NO: 253 H1 mini-HA 127H1-t2 S73L<br>MKVKLLVLLCTFTATYADTICIGYHANNSTDTVDTVLEKNVTVTHSVNLLENGGGGKYVCSAKLR |
| MVTGLRNKPSKQSQGLFGAIAGFTEGGWTGMVDGWYGYHHQNEQGSGYAADQKSTQNAINGITNK |
| VNSVIEKMNTQYTAIGCEYNKLERCMKQIEDKIEEIESKIWCYNAELLVLLENERTLDFHDSNVK |
| NLYEKVKSQLKNNAKEIGNGCFEFYHKCNDECMESVKNGTYDYPKYSEESKLNREKIDGVKLESM |
| GVYQILAIYSTVASSLVLLVSLGAISFWMCSNGSLQCRICI |
| SEQ ID NO: 254 sH1 mini-HA 127H1-t2longS73L (#5114)<br>DTICIGYHANNSTDTVDTVLEKNVTVTHSVNLLENGGGGKYVCSAKLRMVTGLRNKPSKQSQGLF |
| GAIAGFTEGGWTGMVDGWYGYHHQNEQGSGYAADQKSTQNAINGITNKVNSVIEKMNTQYTAIGC |
| EYNKLERCMKQIEDKIEEIESKIWCYNAELLVLLENERTLDFHDSNVKNLYEKVKSQLKNNAKEI |
| GNGCFEFYHKCNDECMESVKNGTYDYPKYSEESKLNREKIDGVKLESMGVYQI |
| SEQ ID NO: 255: UFV150124<br>MKVKLLVLLCTFTATYADTICIGYHANNSTDTVDTVLEKNVTVTHSVNLLENGGGGKYVCSAKLR |
| MVTGLRNKPSKQSQGLFGAIAGFTEGGWTGMVDGWYGYHHQNEQGSGYAADQKSTQNAINGITNK |
| VNSVIEKMNTQYTAIGCEYNKSERCMKQIEDKIEEIESKIWCYNAELLVLLENERTLDFHDSNVK |
| NLYEKVKSQLKNNAKEIGNGCFEFYHKCNDECMESVKNGTYDYPKYSEESKLNREKIDGVSGRDY |
| KDDDDKPGSGYIPEAPRDGQAYVRKDGEWVLLSTFLGHHHHHH |
| SEQ ID NO: 256: UFV150125<br>MKVKLLVLLCTFTATYADTICIGYHANNSTDTVDTVLEKNVTVTHSVNLLENGGGGKYVCSAKLR |
| MVTGLRNKPSKQSQGLFGAIAGFTEGGWTGMVDGWYGYHHQNEQGSGYAADQKSTQNAINGITNK |
| VNSVIEKMNTQYTAIGCEYNKSERCMKQIEDKIEEIESKIWCYNAELLVLLENERTLDFHDSNVK |
| NLYEKVKSQLKNNAKEIGNGCFEFYHKCNDECMESVKNGTYDYPKYSEESKLNREKIDGVKLESM |
| GVYQIEGRAAADYKDDDDKPGSGYIPEAPRDGQAYVRKDGEWVLLSTFLGHHHHHH |
| SEQ ID NO: 257: UFV150134<br>MKAILVVLLYTFATANADTLCIGYHANNSTDTVDTVLEKNVTVTHSVNLLEDGGGGKYVCSTKLR |
| LATGLRNKPSKQSQGLFGAIAGFTEGGWTGMVDGWYGYHHQNEQGSGYAADLKSTQNAIDEITNK |
| VNSVIEKMNTQYTAIGCEYNKSERCMKQIEDKIEEIESKIWCYNAELLVLLENERTLDYHDSNVK |
| NLYEKVRSQLKNNAKEIGNGCFEFYHKCDNTCMESVKNGTYDYPKYSEEAKLNREEIDGVSGRDY |
| KDDDDKPGSGYIPEAPRDGQAYVRKDGEWVLLSTFLGHHHHHH |

SEQUENCES

SEQ ID NO: 258: UFV150135
MKAILVVLLYTFATANADTLCIGYHANNSTDTVDTVLEKNVTVTHSVNLLEDGGGGKYVCSTKLR

LATGLRNKPSKQSQGLFGAIAGFTEGGWTGMVDGWYGYHHQNEQGSGYAADLKSTQNAIDEITNK

VNSVIEKMNTQYTAIGCEYNKSERCMKQIEDKIEEIESKIWCYNAELLVLLENERTLDYHDSNVK

NLYEKVRSQLKNNAKEIGNGCFEFYHKCDNTCMESVKNGTYDYPKYSEEAKLNREEIDGVKLEST

RIYQIEGRAAADYKDDDDKPGSGYIPEAPRDGQAYVRKDGEWVLLSTFLGHHHHHH

SEQUENCE LISTING (258 sequences)

SEQ ID NO: 1 - protein, 565 aa, Artificial Sequence
  H1 Full length (A/Brisbane/59/2007)
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2 - protein, 301 aa, Artificial Sequence
  H1-mini2-cluster1+5+6-GCN4
MKVKLLVLLCTFTATYADTICIGYHANNSTDTVDTVLEKNVTVTHSVNLLENGGGGKYVCSAKLRMVTGLRNIPSIQSQGLFGAIAGFIEGGWTGMVDGWYGYHHQNEQGSGYAADQKSTQNAINGITNKVNSVIEKMNTQSTATGKEGNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3 - protein, 27 aa, Artificial Sequence
  foldon
GYIPEAPRDGQAYVRKDGEWVLLSTFL

SEQ ID NO: 4 - protein, 54 aa, Artificial Sequence
  FLAG-thrombin-foldon-HIS
SGRDYKDDDDKLVPRGSPGSGYIPEAPRDGQAYVRKDGEWVLLSTFLGHHHHHH

SEQ ID NO: 5 - protein, 15 aa, Artificial Sequence
  Trimerization domain
MKQIEDKIEEIESKQ

SEQ ID NO: 6 - protein, 292 aa, Artificial Sequence
  H1-mini2-cluster1+5+6-GCN4 without leader sequence and with FLAG-thrombin-foldon-HIS
DTICIGYHANNSTDTVDTVLEKNVTVTHSVNLLENGGGGKYVCSAKLRMVTGLRNIPSIQSQGLFGAIAGFIEGGWTGMVDGWYGYHHQNEQGSGYAADQKSTQNAINGITNKVNSVIEKMNTQSTATGKEGNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVSGRDYKDDDDKLVPRGSPGSGYIPEAPRDGQAYVRKDGEWVLLSTFLGHHHHHH

SEQ ID NO: 7 - protein, 17 aa, Artificial Sequence
  H1 HA2 amino acid sequence connecting the C-terminal residue of helix A and the N-terminal residue of helix CD
  MISC_FEATURE (14)..(14): X= H OR K
  MISC_FEATURE (17)..(17): X= K OR R
MNTQFTAVGKEFNXLEX

SEQ ID NO: 8 - protein, 17 aa, Artificial Sequence
  H1 HA2 amino acid sequence connecting the C-terminal residue of helix A and the N-terminal residue of helix CD
  MISC_FEATURE (1)..(1): X = M, E, K, V, R, T
  MISC_FEATURE (5)..(5): X = F, I, N, T, H, L, Y
  MISC_FEATURE (8)..(8): X = V, A, G, I, R, F, S
  MISC_FEATURE (12)..(12): X = F, I, N, S, T, Y, E, K, M, V
  MISC_FEATURE (14)..(14): X = H or K
  MISC_FEATURE (15)..(15): X = L, H, I, N, R
  MISC_FEATURE (17)..(17): X = K or R
XNTQXTAXGKEXNXXEX

SEQ ID NO: 9 - protein, 121 aa, Artificial Sequence [sequence omitted]

SEQ ID NO: 10 - protein, 112 aa, Artificial Sequence
  CR6261 VL PROTEIN
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 11 - protein, 121 aa, Artificial Sequence
  SC09-114 VH PROTEIN
QVQLVQSGAEVKKPGSSVKVSCKSSGGTSNNYAISWVRQAPGQGLDWMGGISPIFGSTAYAQKFQGRVTISADIFSNTAYMELNSLTSEDTAVYFCARHGNYYYYSGMDVWGQGTTVTVSS

SEQ ID NO: 12 - protein, 110 aa, Artificial Sequence
  SC09-114 VL PROTEIN
SYVLTQPPAVSGTPGQRVTISCSGSDSNIGRRSVNWYQQFPGTAPKLLIYSNDQRPSVVPDRFSGSKSGTSASLAISGLQSEDEAEYYCAAWDDSLKGAVFGGGTQLTVL

SEQ ID NO: 13 - protein, 116 aa, Artificial Sequence
  SC08-057 VH PROTEIN
EVQLVESGGGLVQPGGSLRLSCAASGFTDSVIFMSWVRQAPGKGLECVSIIYIDDSTYYADSVKGRFTISRHNSMGTVFLEMNSLRPDDTAVYYCATESGDFGDQTGPYHYYAMDV

SEQ ID NO: 14 - protein, 100 aa, Artificial Sequence
  SC08-057 VL PROTEIN
QSALTQPASVSGSPGQSITISCTGSSGDIGGYNAVSWYQHHPGKAPKLMIYEVTSRPSGVSDRFSASRSGDTASLTVSGLQAEDEAHYYCCSFADSNILI

SEQ ID NO: 15 - protein, 6 aa, Artificial Sequence
  Histag
HHHHHH

SEQ ID NO: 16 - protein, 8 aa, Artificial Sequence
  Histag
MHHHHHHH

SEQ ID NO: 17 - protein, 111 aa, Artificial Sequence
  SC08-020 VH
QVQLQQSGAEVKTPGASVKVSCKASGYTFTRFGVSWIRQAPGQGLEWIGWISAYNGDTYYAQKFQARVTMTTDTSTTTAYMEMRSLRSDDTAVYYCAREPPLFYSSWSLDN

SEQ ID NO: 18 - protein, 98 aa, Artificial Sequence
  SC08-020 VL
  misc_feature (4)..(4): Xaa can be any naturally occurring amino acid
EIVXTQSPGTLSLSPGERATLSCRASQSVSMNYLAWFQQKPGQAPRLLIYGASRRATGIPDRISGSGSGTDFTLTISRLEPADFAVYYCQQYGTSPRT

SEQ ID NO: 19 - skipped

SEQ ID NO: 20 - protein, 15 aa, Artificial Sequence
  GCN4 derived sequence
RMKQIEDKIEEIESK

SEQ ID NO: 21 - protein, 17 aa, Artificial Sequence
  GCN4 derived sequence
RMKQIEDKIEEIESKQK

SEQ ID NO: 22 - protein, 8 aa, Artificial Sequence
  FLAG tag
DYKDDDDK

SEQ ID NO: 23 - protein, 6 aa, Artificial Sequence
  thrombin proteolytic site
RSLVPR

SEQ ID NO: 24 - protein, 4 aa, Artificial Sequence
  Factor X proteolytic site
IEGR

SEQ ID NO: 25 - protein, 565 aa, Artificial Sequence
  A/Solomon ISlands/6/2003
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 26 - protein, 564 aa, Artificial Sequence
  A/New Caledonia/20/1999
KAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 27 - protein, 566 aa, Artificial Sequence
  A/California/07/2009
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 28 - protein, 566 aa, Artificial Sequence
  A/swine/Hubei/S1/2009
MEAKLFVLFCAFTALKADTFCVGYHANYSTHTVDTILEKNVTVTHSVNLLENSHNGKLCSLNGKIPLQLGNCNVAGWILGNPKCDLLLTANSSSYIIETSKSKNGACYPGEFADYEELKEQLSTVSSFERFEIFPKAISWPDHDATRGTTVACSHSGVNSFYRNLLSTVKKGNSYPKLSKSYTNNKGKEVLVIWGVHHPPTDSVQQTLYQNKHTYVSVGSSKYYKRFTPEIVARPKVRGQAGRMNYYWTLFDQGDTITFEATGNLIAPWHAFALKKGSSSGIMLSDAQVHNCTTKCQTPHGALKNNLPLQNVHLFTIGECPKYVKSTQLRMATGLRNIPSIQSRGLFGAIAGFIEGGRTGMIDGWYGYHHQNEQGSGYAADQKSTQIAIDGINNKANSVIGKMNIQLTSVGKEFNSLEKRKENLNKTVDDRFLDVWTFNAELLVLLENQRTLEFHDLNIKSLYEKVKSHLRNNDKEIGNGCFEFYHKRDNECLECVKNGTYNYPKYSEESKFNREEIVGVKLESMGIHQILAIYSTVASSLVLLVSLGAISFWMCSNGSLQCRVCI

SEQ ID NO: 29 - protein, 566 aa, Artificial Sequence
  A/swine/Haseluenne/IDT2617/2003
MEAKLFVLFCAFTALKADTICVGYHANNSTDTVDTILEKNVTVTHSINLLENNHNGKLCSLNGKAPLQLGNCNVAGWILGNPECDLLLTVDSWSYIIETSNSKNGACYPGEFADYEELREQLSTVSSFERFEIFPKATSWPNHDTTRGTTISCSHSGANSFYRNLLWIVKKGNSYPKLSKSYTNNKGKEVLVIWGVHHPPTDSDQQTLYQNNHTYVSVGSSKYYQRFTPEIVTRPKVRGQAGRMNYYWTLLDQGDTITFEATGNLIAPWHAFALNKGPSSGIMISDAHVHNCTTKCQTPHGALKSNLPFQNVHPSTIGECPKYVKSTQLRMATGLRNIPSIQSRGLFGAIAGFIEGGWTGMIDGWYGYHHQNEQGSGYAADQKSTQIAIDGINNKVNSIIEKMNTQFTSVGKEFNDLEKRIENLNKKVDDGFLDVWTYNAELLILLENERTLDFHDFNVKNLYEKVKSQLRNNAKEIGNGCFEFYHKCDNECMESVKNGTYNYPKYSEESKLNREKIDGVKLESMGVHQILAIYSTVASSLVLLVSLGAISFWMCSNGSLQCRICI

SEQ ID NO: 30 - protein, 565 aa, Artificial Sequence
  A/New York/8/2006
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNRERIDGVKLESMGVYQILAIYSTVASSLVLLVSLGAISFWMCSNGSLQCRICI

SEQ ID NO: 31 - protein, 565 aa, Artificial Sequence; identical to SEQ ID NO: 25
  A/Solomon Islands/3/2006

SEQ ID NO: 32 - protein, 566 aa, Artificial Sequence
  A/New York/146/2000
MKAKLLVLLCAFTATYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTEKNGLYPNLSKSYVNKKGKEVLVLWGVHHPSNMGDQRAIYHKENAYVSVLSSHYSRRFTPEIAKRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDLNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 33 - protein, 566 aa, Artificial Sequence
  A/New York/653/1996
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEITKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 34 - protein, 565 aa, Artificial Sequence
  A/Beijing/262/1995
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVTASCSHNGKSSFYRNLLWLTEKNGLYPNLSNSYVNNKEKEVLVLWGVHHPSNIRDQRAIYHTENAYVSVVSSHYSRRFTPEIAKRPKVRGQEGRINYYWTLLEPGDTIIFEANGNLIAPWYAFALSRGFGSGIITSNAPMNECDAKCQTPQGAINSSLPFQNVHPVTIGECPKYVRSTKLRMVTGLRNIPSIQSRGLFGAIAGFIEGGWTGMMDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 35 - protein, 600 aa, Artificial Sequence
  A/Texas/36/1991
MKAKLLVLLCAFTATYADTICIGYHANNSTDTVDTVLEKNVTVTHSVNLLEDSHNGKLCRLKGIAPLQLGNCSVAGWILGNPKCESLFSKESWSYIAETPNPENGTCYPGYFADYEELREQLSSVSSFERFEIFPKESSWPNHTVTKGVTTSCSHNGKSSFYRNLLWLTKKNGLYPNVSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENGRTLDFHDSNVKNLYEKVKSQLKNNAKEIGNGMENLNKKVDDGFLDIWTYNAELLVLLENERTLDFHDSNVKNLYEKVKSQLKNNAKEIGNGCFEFYHKCNNECMESVKNGTYDYPKYSEESKLNRGKIDGVKLESMGVYQILAIYSTVASS

SEQ ID NO: 36 - protein, 566 aa, Artificial Sequence
  A/Singapore/6/1986
MKAKLLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHKGRSSFYRNLLWLTKKNGSYPNLSKSYVNNKEKEVLVLWGVHHPSNIGDQRAIYHTENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 37 - protein, 506 aa, Artificial Sequence
  A/Chile/1/1983
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELRESYVNNKEKEVLVLWGVHHPSNIEDQKTIYRKENAYVSVVSSHYNRRFTPEIAKRPKVRNQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 38 - protein, 566 aa, Artificial Sequence
  A/Baylor/11515/1982
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHSVTRGVTASCSHKGKSSFYRNLLWLTEKNGSYPNLSKSYVNDKEKEVLVLWGVHHPSNIEDQKTIYRKENAYVSVVSSHYNRRFTPEIAKRPKVRDQEGRINYYWTLLEPGDTIIFEANGNLIAPWYAFALSRGFGSGIITSNVSMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 39 - protein, 505 aa, Artificial Sequence
  A/Brazil/11/1978
KAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNITRGVTASCSHKGKSSFYRNLLWLTEKNGSYPNLSKSYVNNKEKEVLVLWGVHHPSNIEDQKTIYRKENAYVSVVSSNYNRRFTPEIAKRPKVRGQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGLVLLVSLGAISFWMCSNGSLQCRICI

SEQ ID NO: 40 - protein, 566 aa, Artificial Sequence
  A/USSR/90/1977
MKAKLLVLLCALSATDADTICIGYHANNSTDTVDTVLEKNVTVTHSVNLLEDSHNGKLCRLKGIAPLQLGKCNIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWHAFALNRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 41 - protein, 566 aa, Artificial Sequence; identical to SEQ ID NO: 36
  A/New Jersey/8/1976

SEQ ID NO: 42 - protein, 565 aa, Artificial Sequence
  A/Denver/1957
MKAKLLILLCALSATDADTICIGYHANNSTDTVDTVLEKNVTVTHSVNLLEDSHNGKLCRLKGKAPLQLGNCNIAGWVLGNPECESLLSNRSWSYIAETPNSENGTCYPGDFADYEELREQLSSVSSFERFEIFPKERSWPNHTTRGVTAACPHARKSSFYKNLVWLTEANGSYPNLSRSYVNNQEKEVLVLWGVHHPSNIEEQRALYRKDNAYVSVVSSNYNRRFTPEIAKRPKVRDQSGRMNYYWTLLEPGDTIIFEATGNLIAPWYAFALSRGPGSGIITSNAPLDECDTKCQTPQGAINSSLPFQNIHPVTIGECPKYVRSTKLRMVTGLRNIPSVQSRGLFGAIAGFIEGGWTGMMDGWYGYHHQNEQGSGYAADQKSTQNAINGITNKVNSVIEKMNTQFTAVGKEFNKLEKRMENLNKKVDDGFMDIWTYNAELLVLLENERTLDFHDSNVKNLYEKVKNQLRNNAKELGNGCFEFYHKCDNECMESVKNGTYDYPKYSEESKLNREKIDGVKLESMGVYRILAIYSTVASSLVLLVSLGAISFWMCSNGSLQCRICI

SEQ ID NO: 43 - protein, 566 aa, Artificial Sequence
  A/Albany/4835/1948
MKAKLLVLLCALSATDADTICIGYHANNSTDTVDTVLEKNVTVTHSVNLLEDSHNGKLCRLKGIAPLQLGKCNIAGWILGNPECESLFSKKSWSYIAETPNSENGTCYPGYFADYEELREQLSSVSSFERFEIFPKERSWPKHNITRGVTAACSHKGKSSFYRNLLWLTEKNGSYPNLNKSYVNNKEKEVLVLWGVHHPSNIEDQKTLYRKENAYVSVVSSNYNRRFTPEIAERPKVRGQAGRINYYWTLLEPGDTIIFEANGNLIAPWHAFALSRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 44 - protein, 566 aa, Artificial Sequence
  A/FortMonmouth/1/1947
MKAKLLILLCALTATDADTICIGYHANNSTDTVDTVLEKNVTVTHSVNLLEDSHNGKLCRLKGIAPLQLGKCNIAGWILGNPECESLLSKRSWSYIAETPNSENGACYPGDFADYEELREQLSSVSSFERFEIFPKERSWPKHNITRGVTAACSHAGKSSFYKNLLWLTETDGSYPKLSKSYVNNKEKEVLVLWGVHHPSNIEDQKTLYRKENAYVSVVSSNYNRRFTPEIAERPKVRGQAGRINYYWTLLEPGDTIIFEANGNLIAPWYAFALSRDFGSGIITSNASMDECDTKCQTPQGAINSSLPFQNIHPVTIGECPKYVKSTKLRMVTGLRNIPSIQSRGLFGAIAGFIEGGWTGMIDGWYGYHHQNEQGSGYAADQKSTQNAINWITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 45 - protein, 566 aa, Artificial Sequence
  A/Cameron/1946
MKAKLLILLCALSATDADTICIGYHANNSTDTVDTVLEKNVTVTHSVNLLEDSHNGKLCRLKGIAPLQLGKCNIAGWILGNPECESLLSKRSWSYIAETPNSENGACYPGDFADYEELREQLSSVSSFERFEIFPKGRSWPEHNIDIGVTAACSHAGKSSFYKNLLWLTEKDGSYPNLNKSYVNKKEKEVLILWGVHHPPNIENQKTLYRKENAYVSVVSSNYNRRFTPEIAERPKVRGQAGRINYYWTLLEPGDTIIFEANGNLIAPWYAFALNRGIGSGIITSNASMDECDTKCQTPQGAINSSLPFQNIHPFTIGECPKYVRSTKLRMVTGLRNIPSIQSRGLFGAIAGFIEGGWDGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKFSEESKLNREKIDGVKLESMGVYQILAIYSTVASSLVLLVSLGAISFWMCSNGSLQCRICI

SEQ ID NO: 46 - protein, 566 aa, Artificial Sequence
  A/Weiss/1943
MKARLLVLLCALAATDADTICIGYHANNSTDTVDTILEKNVTVTHSVNLLEDSHNGKLCRLKGIAPLQLGKCNIAGWILGNPECESLLSERSWSYIVEIPNSENGTCYPGDFTDYEELREQLSSVSSFERFEIFPKESSWPKHNTARGVTAACSHAGKSSFYRNLLWLTEKDGSYPNLKNSYVNKKGKEVLVLWGVHHPSSIKEQQTLYQKENAYVSVVSSNYNRRFTPEIAERPKVRDQAGRMNYYWTLLEPGDTIIFEANGNLIAPWYAFALSRGFGSGIITSNASMHECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLILLENERTLDFHDSNVKNLYEKVKSQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 47 - protein, 565 aa, Artificial Sequence
  A/Iowa/1943
MKARLLVLLCALAATDADTICIGYHANNSTDTVDTVLEKNVTVTHSVNLLEDSHNGKLCRLKGIAPLQLGKCNIAGWILGNPECESLLSERSWSYIVETPNSENGTCYPGDFIDYEELREQLSSVSSFERFEIFSKESSWPKHTTGGVTAACSHAGKSSFYRNLLWLTEKDGSYPNLNNSYVNKKGKEVLVLWGVHHPSNIKDQQTLYQKENAYVSVVSSNYNRRFTPEIAERPKVRGQAGRINYYWTLLKPGDTIMFEANGNLIAPWYAFALSRGFGSGIITSNASMHECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTAASSLVLLVSLGAISFWMCSNGSLQCRICI

SEQ ID NO: 48 - protein, 446 aa, Artificial Sequence
  A/Bellamy/1942
MKARLLVLLCAIAATDADTICIGYHANNSTDTVDTILEKNVTVTHSVNLLEDSHNGKLCRLKGIAPLQLGKCNIAGWILGNPECESLLSERSWSYIVETPNSENGTCYPGDFIDYEELREQLSSVTSFERFEIFPKETSWPKHNTTKGVTAACSHAGKCSFYRNLLWLTEKDGSYPNLNNSYVNKKGKEVLVLWGVHHPSNIKDQQTLYQKENAYVSVVSSNYNRRFTPEIAERPKVRGQAGRMNYYWTLLEPGDTIIFEANGNLIAPWYAFALSRGFGSGIITSNASMHECNTKCQTPQMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKSQLRNNAKEIGNGLVLLVSLGAISFWMCSNGSLQCRICI

SEQ ID NO: 49 - protein, 565 aa, Artificial Sequence
  A/Puerto Rico/8/1934
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALRRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNSVIEKMNIQFTAVGKEFNKLEKRMENLNNKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 50 - protein, 565 aa, Artificial Sequence
  A/WSN/1933
MKAKLLVLLYAFVATDADTICIGYHANNSTDTVDTIFEKNVAVTHSVNLLEDRHNGKLCKLKGIAPLQLGKCNITGWLLGNPECDSLLPARSWSYIVETPNSENGACYPGDFIDYEELREQLSSVSSLERFEIFPKESSWPNHTFNGVTVSCSHRGKSSFYRNLLWLTKKGDSYPKLTNSYVNNKGKEVLVLWGVHHPSSSDEQQSLYSNGNAYVSVASSNYNRRFTPEIAARPKVKDQHGRMNYYWTLLEPGDTIIFEATGNLIAPWYAFALSRGFESGIITSNASMHECNTKCQTPQGSINSNLPFQNIHPVTIGECPKYVRSTKLRMVTGLRNIPSIQYRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDLNVKNLYEKVKSQLKNNAKEIGNGCFEFYHKCDNECMESVRNGTYDYPKYSEESKLNREKIDGVKLESMGVYQILAIYSTVASSLVLLVSLGAISFWMCSNGSLQCRICI

SEQ ID NO: 51 - protein, 566 aa, Artificial Sequence
  A/South Carolina/1/1918
MEARLLVLLCAFAATNADTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQILAIYSTVASSLVLLVSLGAISFWMCSNGSLQCRICI

SEQ ID NO: 52 - protein, 301 aa, Artificial Sequence
  H1-mini2-cluster1+5+6-GCN4t2
MKVKLLVLLCTFTATYADTICIGYHANNSTDTVDTVLEKNVTVTHSVNLLENGGGGKYVCSAKLRMVTGLRNIPSIQSQGLFGAIAGFIEGGWTGMVDGWYGYHHQNEQGSGYAADQKSTQNAINGITNKVNSVIEKMNTQSTATGKEGNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 53 - protein, 301 aa, Artificial Sequence
  H1-mini2-cluster1+5+6-GCN4t3
MKVKLLVLLCTFTATYADTICIGYHANNSTDTVDTVLEKNVTVTHSVNLLENGGGGKYVCSAKLRMVTGLRNIPSIQSQGLFGAIAGFIEGGWTGMVDGWYGYHHQNEQGSGYAADQKSTQNAINGITNKVNSVIEKMNTQSTATGKEGNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 54 - skipped

SEQ ID NO: 55 - protein, 301 aa, Artificial Sequence
  127H1
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 56 - protein, 301 aa, Artificial Sequence
  86B4
MKVKLLVLLCTFTATYADTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 57 - protein, 301 aa, Artificial Sequence
  74H9
MKVKLLVLLCTFTATYADTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 58 - protein, 301 aa, Artificial Sequence
  6E12
MKVKLLVLLCTFTATYADTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 59 - protein, 301 aa, Artificial Sequence
  55G7
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 60 - protein, 301 aa, Artificial Sequence
  115A1
MKVKLLVLLCTFTATYADTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 61 - protein, 301 aa, Artificial Sequence
  71H2
MKVKLLVLLCTFTATYADTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 62 - protein, 301 aa, Artificial Sequence
  181H9
MKVKLLVLLCTFTATYADTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 63 - protein, 301 aa, Artificial Sequence
  220C9
MKVKLLVLLCTFTATYADTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 64 - protein, 301 aa, Artificial Sequence
  113E7
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 65 - protein, 253 aa, Artificial Sequence
  s74H9
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 66 - protein, 253 aa, Artificial Sequence
  s127H1
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 67 - protein, 253 aa, Artificial Sequence
  s86B4
DTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 68 - protein, 253 aa, Artificial Sequence
  s55G7
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 69 - protein, 253 aa, Artificial Sequence
  s6E12
DTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 70 - protein, 253 aa, Artificial Sequence
  s115A1
DTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 71 - protein, 253 aa, Artificial Sequence
  s71H2
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 72 - protein, 250 aa, Artificial Sequence
  s74H9-long
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 73 - protein, 250 aa, Artificial Sequence
  s127H1-long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 74 - protein, 250 aa, Artificial Sequence
  s86B4-long
DTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 75 - protein, 250 aa, Artificial Sequence
  s55G7-long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 76 - protein, 253 aa, Artificial Sequence
  s181H9
DTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 77 - protein, 253 aa, Artificial Sequence
  s220C9
DTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 78 - protein, 253 aa, Artificial Sequence
  s113E7
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 79 - protein, 250 aa, Artificial Sequence
  s115A1ong
DTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 80 - protein, 250 aa, Artificial Sequence
  s71H2long
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 81 - protein, 301 aa, Artificial Sequence
  127H1-t2
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 82 - protein, 301 aa, Artificial Sequence
  86B4-t2
MKVKLLVLLCTFTATYADTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 83 - protein, 301 aa, Artificial Sequence
  74H9-t2
MKVKLLVLLCTFTATYADTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 84 - protein, 301 aa, Artificial Sequence
  6E12-t2
MKVKLLVLLCTFTATYADTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 85 - protein, 301 aa, Artificial Sequence
  55G7-t2
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 86 - protein, 301 aa, Artificial Sequence
  115A1-t2
MKVKLLVLLCTFTATYADTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 87 - protein, 301 aa, Artificial Sequence
  71H2-t2
MKVKLLVLLCTFTATYADTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 88 - protein, 301 aa, Artificial Sequence
  181H9-t2
MKVKLLVLLCTFTATYADTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 89 - protein, 301 aa, Artificial Sequence
  220C9-t2
MKVKLLVLLCTFTATYADTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 90 - protein, 301 aa, Artificial Sequence
  113E7-t2
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 91 - protein, 253 aa, Artificial Sequence
  s127H1-t2
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 92 - protein, 253 aa, Artificial Sequence
  s86B4-t2
DTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 93 - protein, 253 aa, Artificial Sequence
  s74H9-t2
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 94 - protein, 253 aa, Artificial Sequence
  s6E12-t2
DTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 95 - protein, 253 aa, Artificial Sequence
  s55G7-t2
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 96 - protein, 253 aa, Artificial Sequence
  s115A1-t2
DTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 97 - protein, 253 aa, Artificial Sequence
  s71H2-t2
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 98 - protein, 253 aa, Artificial Sequence
  s181H9-t2
DTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 99 - protein, 253 aa, Artificial Sequence
  s220C9-t2
DTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 100 - protein, 253 aa, Artificial Sequence
  s113E7-t2
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 101 - protein, 250 aa, Artificial Sequence
  s127H1-t2long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 102 - protein, 250 aa, Artificial Sequence
  s86B4-t2long
DTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 103 - protein, 250 aa, Artificial Sequence
  s74H9-t2long
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 104 - protein, 250 aa, Artificial Sequence
  s6E12-t2long
DTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 105 - protein, 250 aa, Artificial Sequence
  s55G7-t2long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 106 - protein, 250 aa, Artificial Sequence
  s115A1-t2long
DTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 107 - protein, 250 aa, Artificial Sequence
  s71H2-t2long
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 108 - protein, 250 aa, Artificial Sequence
  s181H9-t2long
DTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 109 - protein, 250 aa, Artificial Sequence
  s220C9-t2long
DTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 110 - protein, 250 aa, Artificial Sequence
  s113E7-t2long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 111 - protein, 301 aa, Artificial Sequence
  127H1-t3
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 112 - protein, 301 aa, Artificial Sequence
  86B4-t3
MKVKLLVLLCTFTATYADTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 113 - protein, 301 aa, Artificial Sequence
  74H9-t3
MKVKLLVLLCTFTATYADTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 114 - protein, 301 aa, Artificial Sequence
  6E12-t3
MKVKLLVLLCTFTATYADTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 115 - protein, 301 aa, Artificial Sequence
  55G7-t3
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 116 - protein, 301 aa, Artificial Sequence
  115A1-t3
MKVKLLVLLCTFTATYADTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 117 - protein, 301 aa, Artificial Sequence
  71H2-t3
MKVKLLVLLCTFTATYADTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 118 - protein, 301 aa, Artificial Sequence
  181H9-t3
MKVKLLVLLCTFTATYADTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 119 - protein, 301 aa, Artificial Sequence
  220C9-t3
MKVKLLVLLCTFTATYADTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 120 - protein, 301 aa, Artificial Sequence
  113E7-t3
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 121 - protein, 253 aa, Artificial Sequence
  s127H1-t3
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 122 - protein, 253 aa, Artificial Sequence
  s86B4-t3
DTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 123 - protein, 253 aa, Artificial Sequence
  s74H9-t3
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 124 - protein, 253 aa, Artificial Sequence
  s6E12-t3
DTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 125 - protein, 253 aa, Artificial Sequence
  s55G7-t3
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 126 - protein, 253 aa, Artificial Sequence
  s115A1-t3
DTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 127 - protein, 253 aa, Artificial Sequence
  s71H2-t3
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 128 - protein, 253 aa, Artificial Sequence
  s181H9-t3
DTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 129 - protein, 253 aa, Artificial Sequence
  s220C9-t3
DTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 130 - protein, 253 aa, Artificial Sequence
  s113E7-t3
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGRSLVPRGSPGHHHHHH

SEQ ID NO: 131 - protein, 250 aa, Artificial Sequence
  s127H1-t3long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 132 - protein, 250 aa, Artificial Sequence
  s86B4-t3long
DTICIGYHANNSTDTVDTVLEKNVTVTHSVNLLENGGGGKYVCSAKLRMVTGLRNKPSNQSQGLFGAIAGYKEGGWTGMVDGWYGYHHQNEQGSGYAADQKSTQNAINGITNKVNSVIEKMNTQFTAIGKEMNKIRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 133 - protein, 250 aa, Artificial Sequence
  s74H9-t3long
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQYTAFGKEMNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 134 - protein, 250 aa, Artificial Sequence
  s6E12-t3long
DTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 135 - protein, 250 aa, Artificial Sequence
  s55G7-t3long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 136 - protein, 250 aa, Artificial Sequence
  s115A1-t3long
DTICIGYHANNSTDTVDTVLEKNVTVTHSVNLLENGGGGKYVCSAKLRMVTGLRNKPSKQSQGLFGAIAGYTEGGWTGMVDGWYGYHHQNEQGSGYAADQKSTQNAINGITNKVNSVIEKMNTQITAVGKEYNKIRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 137 - protein, 250 aa, Artificial Sequence
  s71H2-t3long
DTICIGYHANNSTDTVDTVLEKNVTVTHSVNLLENGGGGKYVCSAKLRMVTGLRNKPSNQSQGLFGAIAGFKEGGWTGMVDGWYGYHHQNEQGSGYAADQKSTQNAINGITNKVNSVIEKMNTQLTAIGKEVNKSRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 138 - protein, 250 aa, Artificial Sequence
  s181H9-t3long
DTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 139 - protein, 250 aa, Artificial Sequence
  s220C9-t3long
DTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 140 - protein, 250 aa, Artificial Sequence
  s113E7-t3long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHRMKQIEDKIEEIESKQKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 141 - protein, 250 aa, Artificial Sequence
  s181H9long
DTICIGYHANNSTDTVDTVLEKNVTVTHSVNLLENGGGGKYVCSAKLRMVTGLRNVPSKQSQGLFGAIAGFIEGGWTGMVDGWYGYHHQNEQGSGYAADQKSTQNAINGITNKVNSVIEKMNTQFTAVGKEFNKNERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 142 - protein, 250 aa, Artificial Sequence
  s220C9long
DTICIGYHANNSTDTVDTVLEKNVTVTHSVNLLENGGGGKYVCSAKLRMVTGLRNKPSTQSQGLFGAIAGFTEGGWTGMVDGWYGYHHQNEQGSGYAADQKSTQNAINGITNKVNSVIEKMNTQFTATGKEYNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 143 - protein, 250 aa, Artificial Sequence
  s113E7long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTATGKEINKHERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 144 - protein, 250 aa, Artificial Sequence
  s6E12-long
DTICIGYHANNSTDTVDTVLEKNVTVTHSVNLLENGGGGKYVCSAKLRMVTGLRNEPSNQSQGLFGAIAGFIEGGWTGMVDGWYGYHHQNEQGSGYAADQKSTQNAINGITNKVNSVIEKMNTQLTAFGKEVNKLERMKQIEDKIEEIESKQIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 145 - protein, 292 aa, Artificial Sequence
  SYNTHETIC
  MISC_FEATURE (56)..(56): X1= E, I, K, V, A, or T
  MISC_FEATURE (59)..(59): X2= I, K, R, T, F, N, S, or Y
  MISC_FEATURE (71)..(71): X3= I, D, F, V, Y, A, I, N, S, T
  MISC_FEATURE (72)..(72): X4= I, K, R, T, E, G, V
  MISC_FEATURE (121)..(121): X5= M, E, K, V, R, T
  MISC_FEATURE (125)..(125): X6= F, I, N, S, T, Y, H, L
  MISC_FEATURE (128)..(128): X7= A, G, I, R, T, V, F, S
  MISC_FEATURE (132)..(132): X8= F, I, N, S, T, Y, G, E, K, M, V
  MISC_FEATURE (135)..(135): X9= H, I, L, N, R, S
DTICIGYHANNSTDTVDTVLEKNVTVTHSVNLLENGGGGKYVCSAKLRMVTGLRNXPSXQSQGLFGAIAGXXEGGWTGMVDGWYGYHHQNEQGSGYAADQKSTQNAINGITNKVNSVIEKXNTQXTAXGKEXNKXERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVSGRDYKDDDDKLVPRGSPGSGYIPEAPRDGQAYVRKDGEWVLLSTFLGHHHHHH

SEQ ID NO: 146 - protein, 237 aa, Artificial Sequence
  SYNTHETIC
  MISC_FEATURE (56)..(56): X1= E, I, K, V, A, or T
  MISC_FEATURE (59)..(59): X2= I, K, R, T, F, N, S, or Y
  MISC_FEATURE (71)..(71): X3= I, D, F, V, Y, A, I, N, S, T
  MISC_FEATURE (72)..(72): X4= I, K, R, T, E, G, V
  MISC_FEATURE (121)..(121): X5= M, E, K, V, R, T
  MISC_FEATURE (125)..(125): X6= F, I, N, S, T, Y, H, L
  MISC_FEATURE (128)..(128): X7= A, G, I, R, T, V, F, S
  MISC_FEATURE (132)..(132): X8= F, I, N, S, T, Y, G, E, K, M, V
  MISC_FEATURE (135)..(135): X9= H, I, L, N, R, S
DTICIGYHANNSTDTVDTVLEKNVTVTHSVNLLENGGGGKYVCSAKLRMVTGLRNXPSXQSQGLFGAIAGXXEGGWTGMVDGWYGYHHQNEQGSGYAADQKSTQNAINGITNKVNSVIEKXNTQXTAXGKEXNKXERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDG

SEQ ID NO: 147 - protein, 250 aa, Artificial Sequence
  SYNTHETIC
  MISC_FEATURE (56)..(56): X1= E, I, K, V, A, or T
  MISC_FEATURE (59)..(59): X2= I, K, R, T, F, N, S, or Y
  MISC_FEATURE (71)..(71): X3= I, D, F, V, Y, A, I, N, S, T
  MISC_FEATURE (72)..(72): X4= I, K, R, T, E, G, V
  MISC_FEATURE (121)..(121): X5= M, E, K, V, R, T
  MISC_FEATURE (125)..(125): X6= F, I, N, S, T, Y, H, L
  MISC_FEATURE (128)..(128): X7= A, G, I, R, T, V, F, S
  MISC_FEATURE (132)..(132): X8= F, I, N, S, T, Y, G, E, K, M, V
  MISC_FEATURE (135)..(135): X9= H, I, L, N, R, S
DTICIGYHANNSTDTVDTVLEKNVTVTHSVNLLENGGGGKYVCSAKLRMVTGLRNXPSXQSQGLFGAIAGXXEGGWTGMVDGWYGYHHQNEQGSGYAADQKSTQNAINGITNKVNSVIEKXNTQXTAXGKEXNKXERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 148 - protein, 284 aa, Artificial Sequence
  SYNTHETIC
  MISC_FEATURE (56)..(56): X1= E, I, K, V, A, or T
  MISC_FEATURE (58)..(58): X2= I, K, R, T, F, N, S, or Y
  misc_feature (59)..(59): Xaa can be any naturally occurring amino acid
  MISC_FEATURE (71)..(71): X3= I, D, F, V, Y, A, I, N, S, T
  MISC_FEATURE (72)..(72): X4= I, K, R, T, E, G, V
  MISC_FEATURE (121)..(121): X5= M, E, K, V, R, T
  MISC_FEATURE (125)..(125): X6= F, I, N, S, T, Y, H, L
  MISC_FEATURE (128)..(128): X7= A, G, I, R, T, V, F, S
  MISC_FEATURE (132)..(132): X8= F, I, N, S, T, Y, G, E, K, M, V
  MISC_FEATURE (135)..(135): X9= H, I, L, N, R, S
DTICIGYHANNSTDTVDTVLEKNVTVTHSVNLLENGGGGKYVCSAKLRMVTGLRNXPSXQSQGLFGAIAGXXEGGWTGMVDGWYGYHHQNEQGSGYAADQKSTQNAINGITNKVNSVIEKXNTQXTAXGKEXNKXERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 149 - protein, 301 aa, Artificial Sequence
  55G7-t2-cl14
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERRMKQCCDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 150 - protein, 301 aa, Artificial Sequence
  55G7-t2-cl15
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERRMKQIEDKIEECCSKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 151 - protein, 301 aa, Artificial Sequence
  55G7-t2-cl16
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNCQYTAIGKEMNKLERRMKQIEDKIEEIESCIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 152 - protein, 301 aa, Artificial Sequence
  55G7-t2-cl17
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTCYTAIGKEMNKLERRMKQIEDKIECIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 153 - protein, 301 aa, Artificial Sequence
  55G7-t2-cl18
MKVKLLVLLCTFTATYADTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGCEMNKLERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 154 - protein, 301 aa, Artificial Sequence
  55G7-t2-cl19
MKVKLLVLLCTFTATYADTICIGYHANNSTDTVDTVLCKNVTVTHSVNLLENGGGGKYVCSAKLRMVTGLRNKPSNQSQGLFGAIAGYVEGGWTGMVDGWYGYHHQNEQGSGYAADQKSTQNAINCITNKVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 155 - protein, 301 aa, Artificial Sequence
  55G7-t2-cl21
MKVKLLVLLCTFTATYADTICIGYHANNSTDTVDTVLECNVTVTHSVNLLENGGGGKYVCSAKLRMVTGLRNKPSNQSQGLFGAIAGYVEGGWTGMVDGWYGYHHQNEQGSGYAADQKSTQNAINGITCKVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 156 - protein, 301 aa, Artificial Sequence
  55G7-t2-cl22
MKVKLLVLLCTFTATYADTICIGYHANNSTDTVDTCLEKNVTVTHSVNLLENGGGGKYVCSAKLRMVTGLRNKPSNQSQGLFGAIAGYVEGGWTGMVDGWYGYHHQNEQGSGYAADQKSTQNAINGITNCVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 157 - protein, 301 aa, Artificial Sequence
  55G7-t2-cl23
MKVKLLVLLCTFTATYADTICIGYHANNSTDTVDTVLEKNVTVTHSVNLLENGGGGKYVCSAKLRMVTGLRNKPSNQCQGLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKCLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 158 - protein, 301 aa, Artificial Sequence
  55G7-t2-cl24
MKVKLLVLLCTFTATYADTICIGYHANNSTDTVDTVLEKNVTVTHSVNLLENGGGGKYVCSAKLRMVTGLRNKPSNQSQCLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKNLYEKVKCQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 159 - protein, 301 aa, Artificial Sequence
  55G7-t2-cl25
MKVKLLVLLCTFTATYADTICIGYHANNSTDTVDTVLEKNVTVTHSVNLLENGGGGKYVCSAKLRMVTGLRNKPSNQSQCLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKNLYECVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 160 - protein, 301 aa, Artificial Sequence
  127H1-t2-cl14
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERRMKQCCDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 161 - protein, 301 aa, Artificial Sequence
  127H1-t2-cl15
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERRMKQIEDKIEECCSKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 162 - protein, 301 aa, Artificial Sequence
  127H1-t2-cl16
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNCQYTAIGKEYNKSERRMKQIEDKIEEIESCIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 163 - protein, 301 aa, Artificial Sequence
  127H1-t2-cl17
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTCYTAIGKEYNKSERRMKQIEDKIECIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 164 - protein, 301 aa, Artificial Sequence
  127H1-t2-cl18
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 165 - protein, 301 aa, Artificial Sequence
  127H1-t2-cl19
MKVKLLVLLCTFTATYADTICIGYHANNSTDTVDTVLCKNVTVTHSVNLLENGGGGKYVCSAKLRMVTGLRNKPSKQSQGLFGAIAGFTEGGWTGMVDGWYGYHHQNEQGSGYAADQKSTQNAINCITNKVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 166 - protein, 301 aa, Artificial Sequence
  127H1-t2-cl21
MKVKLLVLLCTFTATYADTICIGYHANNSTDTVDTVLECNVTVTHSVNLLENGGGGKYVCSAKLRMVTGLRNKPSKQSQGLFGAIAGFTEGGWTGMVDGWYGYHHQNEQGSGYAADQKSTQNAINGITCKVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 167 - protein, 301 aa, Artificial Sequence
  127H1-t2-cl22
MKVKLLVLLCTFTATYADTICIGYHANNSTDTVDTCLEKNVTVTHSVNLLENGGGGKYVCSAKLRMVTGLRNKPSKQSQGLFGAIAGFTEGGWTGMVDGWYGYHHQNEQGSGYAADQKSTQNAINGITNCVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 168 - protein, 301 aa, Artificial Sequence
  127H1-t2-cl23
MKVKLLVLLCTFTATYADTICIGYHANNSTDTVDTVLEKNVTVTHSVNLLENGGGGKYVCSAKLRMVTGLRNKPSKQCQGLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKCLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 169 - protein, 301 aa, Artificial Sequence
  127H1-t2-cl24
MKVKLLVLLCTFTATYADTICIGYHANNSTDTVDTVLEKNVTVTHSVNLLENGGGGKYVCSAKLRMVTGLRNKPSKQSQCLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKNLYEKVKCQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 170 - protein, 301 aa, Artificial Sequence
  127H1-t2-cl25
MKVKLLVLLCTFTATYADTICIGYHANNSTDTVDTVLEKNVTVTHSVNLLENGGGGKYVCSAKLRMVTGLRNKPSKQSQCLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKNLYECVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 171 - protein, 250 aa, Artificial Sequence
  s55G7-t2-cl14long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERRMKQCCDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 172 - protein, 250 aa, Artificial Sequence
  s55G7-t2-cl15long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGKEMNKLERRMKQIEDKIEECCSKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 173 - protein, 250 aa, Artificial Sequence
  s55G7-t2-cl16long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNCQYTAIGKEMNKLERRMKQIEDKIEEIESCIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 174 - protein, 250 aa, Artificial Sequence
  s55G7-t2-cl17long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTCYTAIGKEMNKLERRMKQIEDKIECIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 175 - protein, 250 aa, Artificial Sequence
  s55G7-t2-cl18long
DTICIGYHANNSTDTVDTVLEKNVTVTHSVNLLENGGGGKYVCSAKLRMVTGLRNKPSNQSQGLFGAIAGYVEGGWTGMVDGWYGYHHQNEQGSGYAADQKSTQNAINGITNKVNSVIEKMNTQYTAIGCEMNKLERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 176 - protein, 250 aa, Artificial Sequence
  s55G7-t2-cl19long
DTICIGYHANNSTDTVDTVLCKNVTVTHSVNLLENGGGGKYVCSAKLRMVTGLRNKPSNQSQGLFGAIAGYVEGGWTGMVDGWYGYHHQNEQGSGYAADQKSTQNAINCITNKVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 177 - protein, 250 aa, Artificial Sequence
  s55G7-t2-cl21long
DTICIGYHANNSTDTVDTVLECNVTVTHSVNLLENGGGGKYVCSAKLRMVTGLRNKPSNQSQGLFGAIAGYVEGGWTGMVDGWYGYHHQNEQGSGYAADQKSTQNAINGITCKVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 178 - protein, 250 aa, Artificial Sequence
  s55G7-t2-cl22long
DTICIGYHANNSTDTVDTCLEKNVTVTHSVNLLENGGGGKYVCSAKLRMVTGLRNKPSNQSQGLFGAIAGYVEGGWTGMVDGWYGYHHQNEQGSGYAADQKSTQNAINGITNCVNSVIEKMNTQYTAIGKEMNKLERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 179 - protein, 250 aa, Artificial Sequence
  s55G7-t2-cl23long
DTICIGYHANNSTDTVDTVLEKNVTVTHSVNLLENGGGGKYVCSAKLRMVTGLRNKPSNQCQGLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKCLYEKVKSQLKNNAKEIGNGCFEFYHKCNDECMESVKNGTYDYPKYSEESKLNREKIDGVKLESMGVYQIEG

SEQ ID NO: 180 - protein, 250 aa, Artificial Sequence
  s55G7-t2-cl24long
DTICIGYHANNSTDTVDTVLEKNVTVTHSVNLLENGGGGKYVCSAKLRMVTGLRNKPSNQSQCLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKNLYEKVKCQLKNNAKEIGNGCFEFYHKCNDECMESVKNGTYDYPKYSEESKLNREKIDGVKLESMGVYQIEG

SEQ ID NO: 181 - protein, 250 aa, Artificial Sequence
  s55G7-t2-cl25long
DTICIGYHANNSTDTVDTVLEKNVTVTHSVNLLENGGGGKYVCSAKLRMVTGLRNKPSNQSQCLFGAIAGYVEGGWTGMVDGWYGYHHQNEQGSGYAADQKSTQNAINGITNKVNSVIEKMNTQYTAIGKEMNKLERRMKQIEDKIEEIESKIWCYNAELLVLLENERTLDFHDSNVKNLYECVKSQLKNNAKEIGNGCFEFYHKCNDECMESVKNGTYDYPKYSEESKLNREKIDGVKLESMGVYQIEG

SEQ ID NO: 182 - protein, 250 aa, Artificial Sequence
  s127H1-t2-cl14long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERRMKQCCDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 183 - protein, 250 aa, Artificial Sequence
  s127H1-t2-cl15long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGKEYNKSERRMKQIEDKIEECCSKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 184 - protein, 250 aa, Artificial Sequence
  s127H1-t2-cl16long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNCQYTAIGKEYNKSERRMKQIEDKIEEIESCIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 185 - protein, 250 aa, Artificial Sequence
  s127H1-t2-cl17long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTCYTAIGKEYNKSERRMKQIEDKIECIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 186 - protein, 250 aa, Artificial Sequence
  s127H1-t2-cl18long
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 187 - protein, 250 aa, Artificial Sequence
  s127H1-t2-cl19long
DTICIGYHANNSTDTVDTVLCKNVTVTHSVNLLENGGGGKYVCSAKLRMVTGLRNKPSKQSQGLFGAIAGFTEGGWTGMVDGWYGYHHQNEQGSGYAADQKSTQNAINCITNKVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 188 - protein, 250 aa, Artificial Sequence
  s127H1-t2-cl21long
DTICIGYHANNSTDTVDTVLECNVTVTHSVNLLENGGGGKYVCSAKLRMVTGLRNKPSKQSQGLFGAIAGFTEGGWTGMVDGWYGYHHQNEQGSGYAADQKSTQNAINGITCKVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 189 - protein, 250 aa, Artificial Sequence
  s127H1-t2-cl22long
DTICIGYHANNSTDTVDTCLEKNVTVTHSVNLLENGGGGKYVCSAKLRMVTGLRNKPSKQSQGLFGAIAGFTEGGWTGMVDGWYGYHHQNEQGSGYAADQKSTQNAINGITNCVNSVIEKMNTQYTAIGKEYNKSERRMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEG

SEQ ID NO: 190 - protein, 250 aa, Artificial Sequence
  s127H1-t2-cl23long
DTICIGYHANNSTDTVDTVLEKNVTVTHSVNLLENGGGGKYVCSAKLRMVTGLRNKPSKQCQGLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKCLYEKVKSQLKNNAKEIGNGCFEFYHKCNDECMESVKNGTYDYPKYSEESKLNREKIDGVKLESMGVYQIEG

SEQ ID NO: 191 - protein, 250 aa, Artificial Sequence
  s127H1-t2-cl24 long
DTICIGYHANNSTDTVDTVLEKNVTVTHSVNLLENGGGGKYVCSAKLRMVTGLRNKPSKQSQCLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKNLYEKVKCQLKNNAKEIGNGCFEFYHKCNDECMESVKNGTYDYPKYSEESKLNREKIDGVKLESMGVYQIEG

SEQ ID NO: 192 - protein, 250 aa, Artificial Sequence
  s127H1-t2-cl24long
DTICIGYHANNSTDTVDTVLEKNVTVTHSVNLLENGGGGKYVCSAKLRMVTGLRNKPSKQSQCLFGAIAGFTEGGWTGMVDGWYGYHHQNEQGSGYAADQKSTQNAINGITNKVNSVIEKMNTQYTAIGKEYNKSERRMKQIEDKIEEIESKIWCYNAELLVLLENERTLDFHDSNVKNLYECVKSQLKNNAKEIGNGCFEFYHKCNDECMESVKNGTYDYPKYSEESKLNREKIDGVKLESMGVYQIEG

SEQ ID NO: 193 - protein, 15 aa, Artificial Sequence
  GCN4 derived sequence
CMKQIEDKIEEIESK

SEQ ID NO: 194 - protein, 17 aa, Artificial Sequence
  GCN4 derived sequence
RMCQIEDKIEEIESKQK

SEQ ID NO: 195 - protein, 270 aa, Artificial Sequence
  smH1 Cali3964-55G7
MKAILVVLLYTFATANADTLCIGYHANNSTDTVDTVLEKNVTVTHSVNLLEDGGGGKYVCSTKLRLATGLRNKPSNQSQGLFGAIAGYVEGGWTGMVDGWYGYHHQNEQGSGYAADLKSTQNAIDEITNKVNSVIEKMNTQYTAIGKEMNHLERMKQIEDKIEEIESKQIWCYNAELLVLLENERTLDYHDSNVKNLYEKVRSQLKNNAKEIGNGCFEFYHKCDNTCMESVKNGTYDYPKYSEEAKLNREEIDGRSLVPRGSPGHHHHHH

SEQ ID NO: 196 - protein, 270 aa, Artificial Sequence
  smH1 Cali3964-86B4
MKAILVVLLYTFATANADTLCIGYHANNSTDTVDTVLEKNVTVTHSVNLLEDGGGGKYVCSTKLRLATGLRNKPSNQSQGLFGAIAGYKEGGWTGMVDGWYGYHHQNEQGSGYAADLKSTQNAIDEITNKVNSVIEKMNTQFTAIGKEMNHIERMKQIEDKIEEIESKQIWCYNAELLVLLENERTLDYHDSNVKNLYEKVRSQLKNNAKEIGNGCFEFYHKCDNTCMESVKNGTYDYPKYSEEAKLNREEIDGRSLVPRGSPGHHHHHH

SEQ ID NO: 197 - protein, 270 aa, Artificial Sequence
  smH1 Cali3964-127H1
MKAILVVLLYTFATANADTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGKEYNHSERMKQIEDKIEEIESKQIWCYNAELLVLLENERTLDYHDSNVKNLYEKVRSQLKNNAKEIGNGCFEFYHKCDNTCMESVKNGTYDYPKYSEEAKLNREEIDGRSLVPRGSPGHHHHHH

SEQ ID NO: 198 - protein, 270 aa, Artificial Sequence
  smH1 Cali3964-55G7-t2
MKAILVVLLYTFATANADTLCIGYHANNSTDTVDTVLEKNVTVTHSVNLLEDGGGGKYVCSTKLRLATGLRNKPSNQSQGLFGAIAGYVEGGWTGMVDGWYGYHHQNEQGSGYAADLKSTQNAIDEITNKVNSVIEKMNTQYTAIGKEMNHLERRMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGRSLVPRGSPGHHHHHH

SEQ ID NO: 199 - protein, 270 aa, Artificial Sequence
  smH1 Cali3964-86B4-t2
MKAILVVLLYTFATANADTLCIGYHANNSTDTVDTVLEKNVTVTHSVNLLEDGGGGKYVCSTKLRLATGLRNKPSNQSQGLFGAIAGYKEGGWTGMVDGWYGYHHQNEQGSGYAADLKSTQNAIDEITNKVNSVIEKMNTQFTAIGKEMNHIERRMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGRSLVPRGSPGHHHHHH

SEQ ID NO: 200 - protein, 270 aa, Artificial Sequence
  smH1 Cali3964-127H1-t2
MKAILVVLLYTFATANADTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGKEYNHSERRMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGRSLVPRGSPGHHHHHH

SEQ ID NO: 201 - protein, 301 aa, Artificial Sequence
  mH1 Cali3964-127H1-t2
MKAILVVLLYTFATANADTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGKEYNHSERRMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 202 - protein, 301 aa, Artificial Sequence
  mH1 Cali3964-127H1-t2-cl18
MKAILVVLLYTFATANADTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGCEYNKSERCMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 203 - protein, 250 aa, Artificial Sequence
  SEQ ID NO: 203: smH1 Cali3964-127H1-t2-cl18long
DTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGCEYNKSERCMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGVKLESTRIYQIEG

SEQ ID NO: 204 - protein, 566 aa, Artificial Sequence
  FL HA H1N1 A/AA_Marton/43
MKARLLVLLCALAATDADTICIGYHANNSTDTVDTVLEKNVTVTHSVNLLEDSHNGKLCRLKGIAPLQLGKCNIAGWILGNPECESLLSERSWSYIVETPNSENGTCYPGDFIDYEELREQLSSVSSFERFEIFSKESSWPKHNTTRGVTAACSHAGKSSFYRNLLWLTEKDGSYPNLNNSYVNKKGKEVLVLWGVHHPSNIKDQQTLYQKENAYVSVVSSNYNRRFTPEIAERPKVRGQAGRMNYYWTLLKPGDTIMFEANGNLIAPWYAFALSRGFGSGIITSNASMHECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 205 - protein, 565 aa, Artificial Sequence
  FL HA H1N1 A/Texas/UR06-0526/07
MKVKLLVLLCTFTATYADTICIGYHANNSTDTVDTVLEKNVTVTHSVNLLEDSHNGKLCLLKGTAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLISLGAISFWMCSNGSLQCRICI

SEQ ID NO: 206 - protein, 566 aa, Artificial Sequence
  H1N1 A/New York/629/95
MKVKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMSECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 207 - protein, 301 aa, Artificial Sequence
  H1 mini Texas 127H1_t2+cl18
MKVKLLVLLCTFTATYADTICIGYHANNSTDTVDTVLEKNVTVTHSVNLLEDGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLISLGAISFWMCSNGSLQCRICI

SEQ ID NO: 208 - protein, 248 aa, Artificial Sequence
  #5123_sH1 mini Texas 127H1_t2+cl18
DTICIGYHANNSTDTVDTVLEKNVTVTHSVNLLEDGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKNQLKNNAKEIGNGCFEFYHKCNDECMESVKNGTYDYPKYSEESKLNREKIDGVKLESMGVYQI

SEQ ID NO: 209 - protein, 301 aa, Artificial Sequence
  H1 mini NY 127H1_t2+cl18
MKAKLLVLLCAFTATYADTICIGYHANNSTDTVDTVLEKNVTVTHSVNLLEDGGGGKYVCSTKLRMVTGLRNKPSKQSQGLFGAIAGFTEGGWTGMIDGWYGYHHQNEQGSGYAADQKSTQNAIDGITNKVNSVIEKMNTQYTAIGCEYNKSERCMKQIEDKIEEIESKIWCYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 210 - protein, 248 aa, Artificial Sequence
  #5124_sH1 mini NY 127H1_t2+cl18
DTICIGYHANNSTDTVDTVLEKNVTVTHSVNLLEDGGGGKYVCSTKLRMVTGLRNKPSKQSQGLFGAIAGFTEGGWTGMIDGWYGYHHQNEQGSGYAADQKSTQNAIDGITNKVNSVIEKMNTQYTAIGCEYNKSERCMKQIEDKIEEIESKIWCYNAELLVLLENERTLDFHDSNVKNLYEKVKTQLKNNAKEIGNGCFEFYHKCNNECMESVKNGTYDYPKYSEESKLNREKIDGVKLESMGVYQI

SEQ ID NO: 211 - protein, 301 aa, Artificial Sequence
  H1 mini Cal 127H1_t2+cl18
MKAILVVLLYTFATANADTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGCEYNHSERCMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 212 - protein, 248 aa, Artificial Sequence
  sH1 mini Cal 127H1_t2+cl18
DTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGCEYNHSERCMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGVKLESTRIYQI

SEQ ID NO: 213 - protein, 301 aa, Artificial Sequence
  H1 mini Mart 127H1_t2+cl18+loop
MKARLLVLLCALAATDADTICIGYHANNSTDTVDTVLEKNVTVTHSVNLLEDGGGGKYVCSTKLRMVTGLRNKPSKQSQGLFGAIAGFTEGGWTGMIDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 214 - protein, 248 aa, Artificial Sequence
  #5126 sH1 mini Mart 127H1_t2+cl18+loop
DTICIGYHANNSTDTVDTVLEKNVTVTHSVNLLEDGGGGKYVCSTKLRMVTGLRNKPSKQSQGLFGAIAGFTEGGWTGMIDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKNQLRNNAKEIGNGCFEFYHKCNNECMESVKNGTYDYPKYSEESKLNREKIDGVKLESMGVYQI

SEQ ID NO: 215 - protein, 301 aa, Artificial Sequence
  H1 mini Mart 127H1_t2+cl18
MKARLLVLLCALAATDADTICIGYHANNSTDTVDTVLEKNVTVTHSVNLLEDGGGGKYVCSTKLRMVTGLRNKPSKQSQGLFGAIAGFTEGGWTGMIDGWYGYHHQNEQGSGYAADQKSTQNAINGITNKVNSVIEKMNTQYTAIGCEYNNSERCMKQIEDKIEEIESKIWCYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 216 - protein, 264 aa, Artificial Sequence
  sH1 mini Mart 127H1_t2+cl18
MKARLLVLLCALAATDADTICIGYHANNSTDTVDTVLEKNVTVTHSVNLLEDGGGGKYVCSTKLRMVTGLRNKPSKQSQGLFGAIAGFTEGGWTGMIDGWYGYHHQNEQGSGYAADQKSTQNAINGITNKVNSVIEKMNTQYTAIGCEYNNSERCMKQIEDKIEEIESKIWCYNAELLVLLENERTLDFHDSNVKNLYEKVKNQLRNNAKEIGNGCFEFYHKCNNECMESVKNGTYDYPKYSEESKLNREKIDGVKLESMGVYQ

SEQ ID NO: 217 - protein, 562 aa, Artificial Sequence
  FL HA H2N2 A/Adachi/2/57
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRNGLCYPGSFNDYEELKHLLSSVKHFEKVKILPKDRWTQHTTTGGSQACAVSGNPSFFRNMVWLTKKGSDYPVAKGSYNNTSGEQMLIIWGVHHPIDETEQRTLYQNVGTYVSVGTSTLNKRSTPEIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFGNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 218 - protein, 299 aa, Artificial Sequence
  H2 mini Adachi 127H1_t2+cl18
MAIIYLILLFTAVRGDQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYEATGCEYGNLERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 219 - protein, 299 aa, Artificial Sequence
  H2 mini Adachi 127H1_t2+cl18+loop
MAIIYLILLFTAVRGDQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYTAYGCEYNKSERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 220 - protein, 248 aa, Artificial Sequence
  #5119 sH2 mini Adachi 127H1_t2+cl18
DQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYEATGCEYGNLERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQI

SEQ ID NO: 221 - protein, 248 aa, Artificial Sequence
  #5120 sH2 mini Adachi 127H1_t2+cl18+loop
DQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYTAYGCEYNKSERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQI

SEQ ID NO: 222 - protein, 562 aa, Artificial Sequence
  FL HA H2N2 A/Singapore/1/1957
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTEKGSNYPVAKGSYNNTSGEQMLIIWGVHHPNDEKEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMIDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 223 - protein, 299 aa, Artificial Sequence
  H2 mini Sing 127H1_t2+cl18
MAIIYLILLFTAVRGDQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYEAIGCEYSNLERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 224 - protein, 299 aa, Artificial Sequence
  H2 mini Sing 127H1_t2+cl18+loop
MAIIYLILLFTAVRGDQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYTAIGCEYNKSERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 225 - protein, 248 aa, Artificial Sequence
  #5121 sH2 mini Sing 127H1_t2+cl18
DQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYEAIGCEYSNLERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQI

SEQ ID NO: 226 - protein, 248 aa, Artificial Sequence
  #5122 sH2 mini Sing 127H1_t2+cl18+loop
DQICIGYHANNSTEKVDTILERNVTVTHAKDILENGGGGKYVCSEKLVLATGLRNKPQKESQGLFGAIAGFTEGGWQGMVDGWYGYHHSNDQGSGYAADKESTQKAFDGITNKVNSVIEKMNTQYTAIGCEYNKSERCMKQIEDKIEEIESKIWCYNAELLVLMENERTLDFHDSNVKNLYDKVRMQLRDNVKELGNGCFEFYHKCDDECMNSVKNGTYDYPKYEEESKLNRNEIKGVKLSSMGVYQI

SEQ ID NO: 227 - protein, 568 aa, Artificial Sequence
  FL HA H5N1 A/Vietnam/1203/2004
MEKIVLLFAIVSLVKSDQICIGYHANNSTEQVDTIMEKNVTVTHAQDILEKKHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKTRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 228 - protein, 300 aa, Artificial Sequence
  H5 mini VN/1203/2004
MEKIVLLFAIVSLVKSDQICIGYHANNSTEQVDTIMEKNVTVTHAQDILEKGGGGKYVCSNRLVLATGLRNKPQKESQGLFGAIAGFTEGGWQGMVDGWYGYHHSNEQGSGYAADKESTQKAIDGVTNKVNSIIDKMNTQYEAIGCEYNNSERCMKQIEDKIEEIESKIWCYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 229 - protein, 248 aa, Artificial Sequence
  sH5 mini VN/1203/2004
DQICIGYHANNSTEQVDTIMEKNVTVTHAQDILEKGGGGKYVCSNRLVLATGLRNKPQKESQGLFGAIAGFTEGGWQGMVDGWYGYHHSNEQGSGYAADKESTQKAIDGVTNKVNSIIDKMNTQYEAIGCEYNNSERCMKQIEDKIEEIESKIWCYNAELLVLMENERTLDFHDSNVKNLYDKVRLQLRDNAKELGNGCFEFYHKCDNECMESVRNGTYDYPQYSEEARLKREEISGVKLESIGIYQI

SEQ ID NO: 230 - protein, 300 aa, Artificial Sequence
  H5 mini VN/1203/2004+loop
MEKIVLLFAIVSLVKSDQICIGYHANNSTEQVDTIMEKNVTVTHAQDILEKGGGGKYVCSNRLVLATGLRNKPQKESQGLFGAIAGFTEGGWQGMVDGWYGYHHSNEQGSGYAADKESTQKAIDGVTNKVNSIIDKMNTQYTAIGCEYNKSERCMKQIEDKIEEIESKIWCYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 231 - protein, 248 aa, Artificial Sequence
  sH5 mini VN/1203/2004+loop
DQICIGYHANNSTEQVDTIMEKNVTVTHAQDILEKGGGGKYVCSNRLVLATGLRNKPQKESQGLFGAIAGFTEGGWQGMVDGWYGYHHSNEQGSGYAADKESTQKAIDGVTNKVNSIIDKMNTQYTAIGCEYNKSERCMKQIEDKIEEIESKIWCYNAELLVLMENERTLDFHDSNVKNLYDKVRLQLRDNAKELGNGCFEFYHKCDNECMESVRNGTYDYPQYSEEARLKREEISGVKLESIGIYQI

SEQ ID NO: 232 - protein, 560 aa, Artificial Sequence
  FL HA H9N2 A/Hong_Kong/69955/2008
METVSLITMLLVATVINADKICIGYQSTNSTETVDTLTENNVPVTHAKELLHTEHNGMLCATNLGYPLILDTCTIEGLIYGNPSCDLLLGGREWSYIVERPSAVNGLCYPGNVENLEELRSLFSSASSYQRIQIFPDTIWNVSYSGTSKACSDSFYRSMRWLTQKNNAYPIQDAQYTNNREKNILFMWGINHPPTDTAQTNLYTRTDTTTSVATEEINRTFKPLIGPRPLVNGLQGRIDYYWSVLKPGQTLRIRSNGNLIAPWYGHILSGESHGRILKTDLKRGSCTVQCQTEKGGLNTTLPFQNVSKYAFGNCSKYVGVKSLKLAVGLRNVPSRSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRRYQEESKLERQKIEGVKLESEGTYKILTIYSTVASSLVIAMGFAAFLFWAMSNGSCRCNICI

SEQ ID NO: 233 - protein, 301 aa, Artificial Sequence
  H9 mini HK/69955/2009
METVSLITMLLVATVINADKICIGYQSTNSTETVDTLTENNVPVTHAKELLHGGGGKYVCVKSLKLAVGLRNKPSKSSQGLFGAIAGFTEGGWSGLVAGWYGFQHSNDQGVGMAADRDSTQKAIDKITSKVNNIVDKMNKQYEIIDCEYSESERCMKQIEDKIEEIESKIWCYNAELLVLLENQKTLDEHDANVNNLYNKVKRALGSNAVEDGKGCFELYHKCDDQCMETIRNGTYNRRRYQEESKLERQKIEGVKLESEGTYKILTIYSTVASSLVIAMGFAAFLFWAMSNGSCRCNICI

SEQ ID NO: 234 - protein, 247 aa, Artificial Sequence
  sH9 mini HK/69955/2009
DKICIGYQSTNSTETVDTLTENNVPVTHAKELLHGGGGKYVCVKSLKLAVGLRNKPSKSSQGLFGAIAGFTEGGWSGLVAGWYGFQHSNDQGVGMAADRDSTQKAIDKITSKVNNIVDKMNKQYEIIDCEYSESERCMKQIEDKIEEIESKIWCYNAELLVLLENQKTLDEHDANVNNLYNKVKRALGSNAVEDGKGCFELYHKCDDQCMETIRNGTYNRRRYQEESKLERQKIEGVKLESEGTYKI

SEQ ID NO: 235 - protein, 301 aa, Artificial Sequence
  H9 mini HK/69955/2009+loop
METVSLITMLLVATVINADKICIGYQSTNSTETVDTLTENNVPVTHAKELLHGGGGKYVCVKSLKLAVGLRNKPSKSSQGLFGAIAGFTEGGWSGLVAGWYGFQHSNDQGVGMAADRDSTQKAIDKITSKVNNIVDKMNTQYTAIGCEYNKSERCMKQIEDKIEEIESKIWCYNAELLVLLENQKTLDEHDANVNNLYNKVKRALGSNAVEDGKGCFELYHKCDDQCMETIRNGTYNRRRYQEESKLERQKIEGVKLESEGTYKILTIYSTVASSLVIAMGFAAFLFWAMSNGSCRCNICI

SEQ ID NO: 236 - protein, 247 aa, Artificial Sequence
  sH9 mini HK/69955/2009+loop
DKICIGYQSTNSTETVDTLTENNVPVTHAKELLHGGGGKYVCVKSLKLAVGLRNKPSKSSQGLFGAIAGFTEGGWSGLVAGWYGFQHSNDQGVGMAADRDSTQKAIDKITSKVNNIVDKMNTQYTAIGCEYNKSERCMKQIEDKIEEIESKIWCYNAELLVLLENQKTLDEHDANVNNLYNKVKRALGSNAVEDGKGCFELYHKCDDQCMETIRNGTYNRRRYQEESKLERQKIEGVKLESEGTYKI

SEQ ID NO: 237 - protein, 566 aa, Artificial Sequence
  Full length HA H3N2 A/Hong Kong/1/1968
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 238 - protein, 309 aa, Artificial Sequence
  #2999 H3 HK68 mini2-cl9+10+11+12-GCN4t
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTEKESSEGEGRMKQIEDKIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 239 - protein, 309 aa, Artificial Sequence
  #3801 H3 HK mini2a-linker+cl9 +10+11+12+GCN4T-CG7-1
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTEKESSNATGRMKQIEDKIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 240 - protein, 309 aa, Artificial Sequence
  #2999-cl14
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTEKESSEGEGRMKQCCDKIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 241 - protein, 309 aa, Artificial Sequence
  #2999 cl15
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTEKESSEGEGRMKQIEDKIEECCSKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 242 - protein, 309 aa, Artificial Sequence
  #2999 cl17
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNECSHQTEKESSEGEGRMKQIEDKIECIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 243 - protein, 309 aa, Artificial Sequence
  #2999 cl18
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTECESSEGEGCMKQIEDKIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 244 - protein, 309 aa, Artificial Sequence
  #2999 cl30
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHCTEKESSEGEGRMKQIEDCIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 245 - protein, 309 aa, Artificial Sequence
  #2999 cl31
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQCEKESSEGEGRMKQIEDCIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 246 - protein, 309 aa, Artificial Sequence
  #3801-cl14
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTEKESSNATGRMKQCCDKIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 247 - protein, 309 aa, Artificial Sequence
  #3801 cl15
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTEKESSNATGRMKQIEDKIEECCSKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 248 - protein, 309 aa, Artificial Sequence
  #3801 cl17
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNECSHQTEKESSNATGRMKQIEDKIECIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 249 - protein, 309 aa, Artificial Sequence
  #3801 cl18
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQTECESSNATGCMKQIEDKIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 250 - protein, 309 aa, Artificial Sequence
  #3801 cl30
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHCTEKESSNATGRMKQIEDCIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 251 - protein, 309 aa, Artificial Sequence
  #3801 cl31
MKTIIALSYIFCLALGQDLPGNDNSTATLCLGHHAVPNGTLVKTITDDQIEVTNATELVQSGGGGKYVCQNTLKLATGMRNVPEKQTQGLFGAIAGFIENGWEGMIDGWYGFRHQNSEGTGQAADLKSTQAAIDQINGKLNRVREKTNEKSHQCEKESSNATGRMKQIEDCIEEIESKLWCYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 252 - protein, 566 aa, Artificial Sequence; identical to SEQ ID NO: 27
  FL HA H1N1 A/California/07/2009

SEQ ID NO: 253 - protein, 301 aa, Artificial Sequence
  H1 mini-HA 127H1-t2 S73L
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKLERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 254 - protein, 248 aa, Artificial Sequence
  sH1 mini-HA 127H1-t2longS73L (#5114)
DTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKLERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQI

SEQ ID NO: 255 - protein, 303 aa, Artificial Sequence
  UFV150124
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVSGRDYKDDDDKPGSGYIPEAPRDGQAYVRKDGEWVLLSTFLGHHHHHH

SEQ ID NO: 256 - protein, 316 aa, Artificial Sequence
  UFV150125
MKVKLLVLLCTFTATYADTICIGYHANNSTDTVDTVLEKNVTVTHSVNLLENGGGGKYVCSAKLRMVTGLRNKPSKQSQGLFGAIAGFTEGGWTGMVDGWYGYHHQNEQGSGYAADQKSTQNAINGITNKVNSVIEKMNTQYTAIGCEYNKSERCMKQIEDKIEEIESKIWCYNAELLVLLENERTLDFHDSNVKNLYEKVKSQLKNNAKEIGNGCFEFYHKCNDECMESVKNGTYDYPKYSEESKLNREKIDGVKLESMGVYQIEGRAAADYKDDDDKPGSGYIPEAPRDGQAYVRKDGEWVLLSTFLGHHHHHH

SEQ ID NO: 257 - protein, 303 aa, Artificial Sequence
  UFV150134
MKAILVVLLYTFATANADTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGCEYNKSERCMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGVSGRDYKDDDDKPGSGYIPEAPRDGQAYVRKDGEWVLLSTFLGHHHHHH

SEQ ID NO: 258 - protein, 316 aa, Artificial Sequence
  UFV150135
MKAILVVLLYTFATANADTLCIGYHANNSTDTVDTVLEKNVTVTHSVNLLEDGGGGKYVCSTKLRLATGLRNKPSKQSQGLFGAIAGFTEGGWTGMVDGWYGYHHQNEQGSGYAADLKSTQNAIDEITNKVNSVIEKMNTQYTAIGCEYNKSERCMKQIEDKIEEIESKIWCYNAELLVLLENERTLDYHDSNVKNLYEKVRSQLKNNAKEIGNGCFEFYHKCDNTCMESVKNGTYDYPKYSEEAKLNREEIDGVKLESTRIYQIEGRAAADYKDDDDKPGSGYIPEAPRDGQAYVRKDGEWVLLSTFLGHHHHHH

The invention claimed is:

1. A multimeric influenza hemagglutinin stem domain polypeptide, wherein the multimeric influenza hemagglutinin stem domain polypeptide comprises at least a first and a second influenza hemagglutinin stem domain monomer, said first and second monomer each comprising: (a) an influenza hemagglutinin HA1 domain that comprises an HA1 amino (N)-terminal stem segment, wherein said HA1 N-terminal segment comprises the amino acids 1-52 of HA1, preferably the amino acids 18-52 of HA1, covalently linked by a linking sequence of less than 10 residues to an HA1 carboxy (C)-terminal stem segment, comprising the amino acids from position 321 to the C-terminal amino acid of HA1, wherein said HA1 C-terminal segment is linked to (b) an influenza hemagglutinin HA2 domain, and
   (c) wherein the polypeptide comprises no protease cleavage site at the junction between the HA1 and HA2 domains; and
   (d) wherein the first monomer is linked to said second monomer by a disulfide bridge between the amino acid on position 411 of the first monomer and the amino acid on position 419 of the second monomer, and wherein in each influenza hemagglutinin stem domain monomer the region comprising the amino acid residues 402-418 comprises the amino acid sequence $X_1NTQX_2TAX_3GKEX_4N(H/K)X_5E(K/R)$ (SEQ ID NO: 8),
   wherein $X_1$ is M, $X_2$ is Y, $X_3$ is I, $X_4$ is Y and $X_5$ is S; and
   wherein in each influenza hemagglutinin stem domain monomer the amino acid sequence CMKQIEDKIEE-IESK (SEQ ID NO: 193) has been introduced at positions 419-433; and
   wherein the amino acid residue on position 337 is K; the amino acid residue on position 340 is K, the amino acid residue on position 352 is F and the amino acid residue on position 353 is T;
   wherein the HA1 and HA2 domains are derived from an influenza A virus subtype derived from phylogenetic group 1, preferably from an influenza A virus subtype comprising HA of the H1 subtype, and wherein the numbering of the amino acid positions is in relation to SEQ ID NO: 1.

2. The multimeric influenza hemagglutinin stem domain polypeptide according to claim 1, wherein the multimeric polypeptide is trimeric.

3. The multimeric influenza hemagglutinin stem domain polypeptide according to claim 1, wherein the HA2 domain of each influenza hemagglutinin stem domain monomer has been truncated.

4. The multimeric influenza hemagglutinin stem domain polypeptide according to claim 3, wherein the C-terminal part of the HA2 domain from position 519 to the C-terminal amino acid has been deleted.

5. The multimeric influenza hemagglutinin stem domain polypeptide according to claim 3, wherein the C-terminal part of the HA2 domain from position 530 to the C-terminal amino acid has been deleted.

6. The multimeric influenza hemagglutinin stem domain polypeptide according to claim 3, wherein the C-terminal part of the HA2 domain has been replaced by the amino acid sequence GYIPEAPRDGQAYVRKDGEWVLLSTFL (SEQ ID NO: 3), optionally connected through a linker.

7. The multimeric influenza hemagglutinin stem domain polypeptide according to claim 1, wherein the C- terminal amino acid residue of the HA1 C-terminal stem segment of each influenza hemagglutinin stem domain monomer is any amino acid other than arginine (R) or lysine (K), preferably glutamine (Q).

8. The multimeric influenza hemagglutinin stem domain polypeptide according to claim 1, wherein the polypeptide comprises one or more further mutations in the HA1domain and/or the HA2 domains.

9. The multimeric influenza hemagglutinin stem domain polypeptide according to claim 1, wherein the polypeptide selectively binds to the antibodies CR6261 and/or CR9114.

10. A nucleic acid molecule encoding the polypeptide of claim 1.

11. A vector comprising the nucleic acid molecule of claim 10.

12. A composition comprising the polypeptide according to claim 1 and a pharmaceutically acceptable carrier.

13. A composition comprising the nucleic acid molecule according to claim 10 and a pharmaceutically acceptable carrier.

14. A method of inducing an immune response against influenza virus in a subject in need thereof, the method comprising administering to the subject in need thereof the polypeptide according to claim 1.

15. A method of inducing an immune response against influenza in a subject in need thereof, the method comprising administering to the subject in need thereof the nucleic acid molecule according to claim 10.

16. A method of inducing an immune response against influenza in a subject in need hereof, the method comprising administering to the subject in need thereof the vector according to claim 11.

17. A composition comprising the vector according to claim 11 and a pharmaceutically acceptable carrier.

18. The multimeric influenza hemagglutinin stem domain polypeptide according to claim 1, wherein each polypeptide monomer comprises the amino acid sequence:
DTICIGYHANNSTDTVDTVLEKNVTVTHSVNLL-ENGGGGKYVCSAKLRMVTGLRNX$_1$PSX$_2$QSQ-GLFGAIAGX$_3$X$_4$EGGWTGMVDGWYGYHHQNE-QGSGYAADQKSTQNAINGITNKVNSVIEKX$_5$N-TQX$_6$TAX$_7$GCEX$_8$NKX$_9$ERCMKQIEDKIEEIES-KIWCYNAELLVLLENERTLDFHDSNVKNLYEK-VKSQLKNNAKEIGNGCFEFYHKCNDECMES-VKNGTYDYPKYSEESKLNREKIDG (SEQ ID NO: 146), wherein $X_1$ is K, $X_2$ is K, $X_3$ is F, $X_4$ is T, $X_5$ is M, $X_6$ is Y, $X_7$ is I, $X_8$ is Y and $X_9$ is S.

19. The multimeric influenza hemagglutinin stem domain polypeptide according to claim 1, wherein each polypeptide monomer comprises the amino acid sequence:
DTICIGYHANNSTDTVDTVLEKNVTVTHSVNL-LENGGGGKYVCSAKLRMVTGLRNX$_1$PSX$_2$Q-SQGLFGAIAGX$_3$X$_4$EGGWTGMVDGWYGYHH-QNEQGSGYAADQKSTQNAINGITNKVNSVIE-KX$_5$NTQX$_6$TAX$_7$GCEX$_8$NKX$_9$ERCMKQIEDKI-EEIESKIWCYNAELLVLLENERTLDFHDSNVKN-LYEKVKSQLKNNAKEIGNGCFEFYHKCNDEC-MESVKNGTYDYPKYSEESKLN-REKIDGVKLESMGVYQIEG (SEQ ID NO: 147), wherein $X_1$ is K, $X_2$ is K, $X_3$ is F, $X_4$ is T, $X_5$ is M, $X_6$ is Y, $X_7$ is I, $X_8$ is Y and $X_9$ is S.

20. The multimeric influenza hemagglutinin stem domain polypeptide according to claim 1, wherein each polypeptide monomer comprises the amino acid sequence:
DTICIGYHANNSTDTVDTVLEKNVTVTHSVNLLE-NGGGGKYVCSAKLRMVTGLRNX$_1$PSX$_2$QSQG-LFGAIAGX$_3$X$_4$EGGWTGMVDGWYGYHHQNE-QGSGYAADQKSTQNAINGITNKVNSVIEKX$_5$N-TQX$_6$TAX$_7$GCEX$_8$NKX$_9$ERCMKQIEDKIEEIES-KIWCYNAELLVLLENERTLDFHDSNVKNLYEK-VKSQLKNNAKEIGNGCFEFYHKCNDECMES-VKNGTYDYPKYSEESKLN-REKIDGVKLESMGVYQILAIYSTVASSLVLLVSL-GAISFWMCSNGSLQCRICI (SEQ ID NO: 148), wherein $X_1$ is K, $X_2$ is K, $X_3$ is F, $X_4$ is T, $X_5$ is M, $X_6$ is Y, $X_7$ is I, $X_8$ is Y and $X_9$ is S.

21. The multimeric influenza hemagglutinin stem domain polypeptide according to claim 1, wherein each polypeptide monomer comprises an amino acid sequence selected from the group consisting of SEQ ID NO: 164, 186, 202, 203, 207-216, 218-226, and 254-258.

\* \* \* \* \*